(12) United States Patent
Minshull et al.

(10) Patent No.: US 8,975,042 B2
(45) Date of Patent: Mar. 10, 2015

(54) FLUORESCENT AND COLORED PROTEINS AND METHODS FOR USING THEM

(71) Applicant: DNA Twopointo, Inc., Menlo Park, CA (US)

(72) Inventors: Jeremy Minshull, Los Altos, CA (US); Elias Theodorou, Hamden, CT (US)

(73) Assignee: DNA Twopointo, Inc., Menlo Park, CA (US)

( * ) Notice: Subject to any disclaimer, the term of this patent is extended or adjusted under 35 U.S.C. 154(b) by 0 days.

(21) Appl. No.: 13/791,821

(22) Filed: Mar. 8, 2013

(65) Prior Publication Data

US 2014/0178914 A1    Jun. 26, 2014

Related U.S. Application Data

(60) Provisional application No. 61/745,498, filed on Dec. 21, 2012.

(51) Int. Cl.
| | | |
|---|---|---|
| *C12P 21/04* | (2006.01) | |
| *C12Q 1/44* | (2006.01) | |
| *C07H 21/02* | (2006.01) | |
| *C12Q 1/02* | (2006.01) | |
| *C07K 14/00* | (2006.01) | |
| *C12Q 1/68* | (2006.01) | |

(52) U.S. Cl.
CPC . *C12Q 1/02* (2013.01); *C07K 14/00* (2013.01); *C12Q 1/6876* (2013.01)
USPC ............................ 435/69.7; 435/19; 536/23.1

(58) Field of Classification Search
None
See application file for complete search history.

(56) References Cited

U.S. PATENT DOCUMENTS 7,879,557 B2 *   2/2011   Golz et al. ..................... 435/7.1

FOREIGN PATENT DOCUMENTS

| WO | WO 2013/116698 | * | 2/2013 | ............. | C12N 15/10 |
| WO | WO 2013/059362 | * | 4/2013 | ............... | C12N 1/00 |

OTHER PUBLICATIONS

Mosser et al., "Use of a Dicistronic Expression Cassette Encoding the Green Fluorescent Protein for the Screening and Selection of Cells Expressing Inducible Gene Products", BioTechniques 22:150-161 (Jan. 1997).*
Kokoza et al., "Efficient transformation of the yellow fever mosquito *Aedes aegypti* using the piggyBac transposable element vector pBac[3xP3-EGFP afm]", Insect Biochemistry and Molecular Biology 31 (2001) 1137-1143.*
Gonzalez et al., "Generation of stable *Drosophila* cell lines using multicistronic vectors", Scientific Reports, 2011, 1:75, DOI: 10.1038/srep00075.*
Merkulov et al., "Libraries of green fluorescent protein fusions generated by transposition in vitro", Gene 222 (1998) 213-222.*
Tsien, R.Y., "The Green Fluorescent Protein," Annu. Rev. Biochem., 67: 509-544 (1998).
Prasher, et al., "Primary Structure of the *Aequorea victoria* Green-Fluorescent Protein," Gene, 111: 229-233 (19920.
Prasher, D.C., "Using GFP to See the Light," Trends in Genetics, 11 (8): 320-323 (1995).
Levine, et al., "Isolation and Characterization of a Photoprotein 'Phialidin' and a Spectrally Unique Green-Fluorescent Protein from the Bioluminescent Jellyfish Phialidium gregarium," Comp. Biochem. Physiol., 72B: 77-85 (1982).
Cubitt, AB., et al. "Understanding, Improving and Using Green Fluorescent Proteins" Trends Biochem Sci. (1995) vol. 20, No. 11, pp. 448-455, Abstract.
Matz et al., Fluorescent Proteins From Nonbioluminescent Anthozoa Species, Nature Biotechnology, vol. 17, Oct. 1999, pp. 969973.
Zhuo, Lang et al. "Live Astrocytes Visualized by Green Flourescent Protein in Transgenic Mice," Developmental Biology 187, 36-42 (1997), Article No. DB978601.

* cited by examiner

*Primary Examiner* — Suzanne M Noakes
(74) *Attorney, Agent, or Firm* — Alston & Bird LLP

(57) ABSTRACT

The field of this invention relates to methods for combining genetic elements such that the activity of one of the elements provides a means for identifying, enriching, selecting for, or enhancing the activity of a second element. The invention also includes specific elements and combinations of elements.

24 Claims, 26 Drawing Sheets

*pellet color: - is no color, + is slight color, ++ is more color,*
*+++ is brightest color, under UV light*

| gene id | clone 1 | clone 2 | clone 3 | clone 4 | clone 5 | clone 6 | clone 7 | clone 8 | clone 9 | clone 10 | clone 11 | clone 12 |
|---|---|---|---|---|---|---|---|---|---|---|---|---|
| 81844 | + | + | + | + | + | + | - | - | ++ | ++ | ++ | +++ |
| 81845 | +++ | - | + | + | - | + | ++ | - | ++ | - | - | ++ |
| 82269 | - | - | - | + | - | - | + | - | +++ | - | - | + |
| 82270 | + | - | + | + | + | - | + | + | ++ | - | + | ++ |
| 82271 | - | - | - | - | - | - | - | - | - | - | - | - |

FIGURE 1

Lane 1: MW marker
Lane 2: *K. pastoris* negative control
Lane 3: 81844
Lane 4: 81845

← Colored protein

Colored boxes represent clones chosen for the gel

|  |  | 1 | 2 | 3 | 4 | 5 | 6 | 7 | 8 | 9 | 10 | 11 | 12 |
|---|---|---|---|---|---|---|---|---|---|---|---|---|---|
| 82269 | a | 0 | 1 | 0 | 3 | 1 | 1 | 2 | 0 | 0 | 0 | 0 | 0 |
|  | b | 4 | 0 | 0 | 2 | 2 | 1 | 0 | 3 | 2 | 3 | 0 | 0 |
|  | c | 0 | 0 | 0 | 1 | 0 | 1 | 4 | 0 | 0 | 0 | 0 | 0 |
|  | d | 0 | 0 | 0 | 0 | 0 | 0 | 4 | 0 | 0 | 5 | 2 | 0 |
| 82270 | e | 2 | 0 | 0 | 0 | 0 | 1 | 0 | 1 | 0 | 0 | 3 | 0 |
|  | f | 1 | 3 | 0 | 0 | 0 | 0 | 3 | 4 | 0 | 0 | 0 | 0 |
|  | g | 1 | 5 | 0 | 0 | 0 | 3 | 1 | 0 | 2 | 1 | 0 | 0 |
|  | h | 0 | 0 | 0 | 0 | 0 | 0 | 0 | 0 | 1 | 1 | 0 | neg cont |

The numbers in the boxes represent color expression of the pellet: 0 is no color, while 5 is very strong color.
82269 had 17/48 colored cultures: 35.4% positive.
82270 had 16/47 colored cultures: 34% positive

FIGURE 5

| GENE ID | DESCRIPTOR | NO COLOR | LOW COLOR | MEDIUM COLOR | HIGH COLOR | VERY HIGH COLOR |
|---|---|---|---|---|---|---|
| 94022 | A_oryzae_ 932: secreted cutinase-6xHis | 3/54 clones | 3/54 clones | 42/54 clones | 2/54 clones | 3/54 clones |
| 94024 | A_oryzae_ 922: cytoplasmic Cutinase-6xHis | 0/32 clones | 0/32 clones | 28/32 clones | 3/32 clones | 1/32 clones |

FIGURE 8

| GENE ID | DESCRIPTOR | NO COLOR | LOW COLOR | MEDIUM COLOR | HIGH COLOR |
|---|---|---|---|---|---|
| 87858 | Magenta_Pol cytoplasmic | 5/26 | 3/26 | 13/26 | 5/26 |
| 87859 | Pink_Pol cytoplasmic | 3/25 | 3/25 | 17/25 | 2/25 |
| 87860 | Purple_Pol cytoplasmic | 14/31 | 9/31 | 7/31 | 1/31 |

FIGURE 10

| GENE ID | DESCRIPTOR | NO COLOR | LOW COLOR | MEDIUM COLOR | HIGH COLOR |
|---|---|---|---|---|---|
| 84674 | 78389_mouse pJ902, pink | 2/48 | 46/48 | 0/48 | 0/48 |
| 84675 | 78389_EMCV pJ902, Pink | 0/23 | 22/23 | 1/23 | 0/24 |

FIGURE 12

| GENE ID | DESCRIPTOR | NO COLOR | LOW COLOR | MEDIUM COLOR | HIGH COLOR |
|---|---|---|---|---|---|
| 84676 | 78390_mouse pJ902, purple | 1/24 | 18/24 | 2/24 | 3/24 |
| 84677 | 78390_EMCV pJ902, purple | 0/24 | 14/24 | 9/24 | 1/24 |

FIGURE 14

| GENE ID | DESCRIPTOR | NO COLOR | LOW COLOR | MEDIUM COLOR | HIGH COLOR |
|---|---|---|---|---|---|
| 84681 | 81846_EMCV pJ902, green | 0/23 | 15/23 | 6/23 | 1/23 |

FIGURE 16

Coomasie ← Cutinase

| GENE ID | DESCRIPTOR | NO COLOR | LOW COLOR | MEDIUM COLOR | HIGH COLOR |
|---|---|---|---|---|---|
| 95814 | Red6_Pp2_87660_secreted | 24/24 No red in supt. | | | |
| 95815 | Red3_Pp1_90991 | 0/16 | 0/16 | 3/16 | 13/16 |
| 95816 | Red4_Pp1 | 1/16 | 5/16 | 9/16 | 1/16 |
| 95817 | Red5_Pp1 | 0/16 | 1/16 | 12/16 | 2/16 |

FIGURE 18

| GENE ID | DESCRIPTOR | NO COLOR | LOW COLOR | MEDIUM COLOR | HIGH COLOR |
|---|---|---|---|---|---|
| 95951 | A_oryzae_931 Geneticin-R | 3/24 | 13/24 | 6/24 | 1/24 |
| 95952 | A_oryzae_921 Geneticin-R | 1/16 | 0/16 | 15/16 | 0/16 |
| 95954 | 911_secreted Protein (BsaI) Geneticin-R | 24/24 | 0/24 | 0/24 | 0/24 |

FLUORESCENT AND COLORED PROTEINS AND METHODS FOR USING THEM

1. FIELD OF THE INVENTION

The field of this invention relates to methods for combining genetic elements such that the activity of one of the elements provides a means for identifying, enriching, selecting for, or enhancing the activity of a second element. The invention also includes specific elements and combinations of elements.

2. BACKGROUND OF THE INVENTION

Transformation of living cells with genetic constructs frequently results in a heterogeneous population.

In some cases the biological effect of the construct is different in different individual cells. This can result from different interactions between a first cell and a first genetic construct, and a second cell and a second genetic construct, even though the first and second genetic constructs may have identical sequences. Such different interactions may result, for example, in the case of genetic constructs that integrate into the chromosome of the cell. Integration often does not occur at a predetermined location within the chromosome, and the behavior of a genetic construct often depends upon the location where it integrates: genes integrated into some parts of the chromosome are well expressed, while those in other parts are poorly expressed. It may be advantageous to distinguish those cells in which one or more genes in a genetic construct is highly expressed from those in which one or more genes in a genetic construct is poorly expressed. It may be advantageous to separate cells based on the level at which they express one or more genes in a genetic construct.

In some cases a genetic construct may not enter every cell in the transformed population. It may be advantageous to distinguish those cells in which one or more genes in a genetic construct is expressed from those in which one or more genes in a genetic construct is not expressed.

In some cases a first cell may possess more copies of a genetic construct than a second cell. Such differences in copy number may cause a gene in the genetic construct to be more highly expressed in the first cell than the second cell. It may be advantageous to distinguish those cells in which one or more genes in a genetic construct is more highly expressed from those in which one or more genes in a genetic construct is less well expressed.

Expression differences may result from other causes. The genetic constructs may not be identical, and differences in expression of a gene in the genetic construct may result from differences in one or more components of the genetic construct, including the promoter, the sequences that govern initiation translation sequences, and the sequence that encodes a polypeptide sequence. Whatever the cause of the differences, it may be advantageous to distinguish those cells in which one or more genes in a genetic construct are more highly expressed from those in which one or more genes in a genetic construct are expressed at lower levels.

Identification of the expression level or expression characteristics of a gene from a genetic construct introduced into a cell can be a laborious process. For example a clonal population of cells may be grown, harvested and analyzed, for example by Western blot, to measure the amount of protein being produced by those cells. It may sometimes be necessary to perform this procedure for 10 or 20 or 30 or 40 or 50 or 60 or 70 or 80 or 90 or 96 or 100 clonal populations, or more, in order to identify cells in which the gene is expressed at the desired level. There is therefore a need in the art for methods to more easily identify cells in which a gene is expressed at a desired level.

3. SUMMARY OF THE INVENTION

The introduction of certain sequences within a genetic construct can cause the expression levels of two or more proteins to be correlated. If the amount of one of these proteins can be measured, the amount of the other protein or proteins can be inferred. If the amount of one of the expressed proteins results in a phenotype that provides a physical, chemical or biological method for selecting cells on the basis of how much of one of the proteins is expressed, these selected cells will also be those that are more likely to express comparable levels of the other protein or proteins expressed in the genetic construct.

Messenger RNA molecules in eukaryotic cells are generally monocistronic, that is they usually encode a single polypeptide. This is because translation in eukaryotes generally occurs by a process in which the ribosome binds to a structure at the 5' end of the mRNA and then "scans" down the mRNA until it finds an initiation codon (generally AUG) where it begins translation. It then translates the mRNA, producing the encoded polypeptide, until it reaches a termination codon (generally UAA, UAG or UGA) which causes the ribosome to end translation and dissociate from the mRNA. Certain eukaryotic viruses have evolved mechanisms by which they can express more than one polypeptide from a single mRNA. These include internal ribosome entry sites (IRES), and cis-acting hydrolase element (CHYSEL) sequences. An IRES provides a structure to which the ribosome can bind that does not need to be at the 5' end of the mRNA. It can therefore direct a ribosome to initiate translation at a second initiation codon within a mRNA, allowing more than 1 polypeptide to be produced from a single mRNA. A CHYSEL sequence causes a translating eukaryotic ribosome to release the growing polypeptide chain that it is synthesizing without dissociating from the mRNA. The ribosome continues translating, and therefore produces a second polypeptide. A single genetic construct can contain more than one IRES or CHYSEL sequence, and it can contain both IRES and CHYSEL sequences, so can therefore encode 2 or 3 or 4 or 5 or 6 or more than 6 polypeptides on a single mRNA.

IRES or CHYSEL sequences can therefore be used as coupling elements, to link the expression of a gene of interest to the expression of a selectable protein that provides a physical, chemical or biological method for selecting cells on the basis of how much of the selectable protein is expressed. The use of certain selectable proteins to indicate the status or functionality of a genetic construct within an organism is an aspect of the invention. The combining of selectable proteins with IRES or CHYSEL sites to indicate the status or functionality of a genetic construct, or to indicate the level of expression of another polypeptide from the genetic construct is another aspect of the invention.

Linker sequences can also be used to link one or more of the proteins disclosed herein with a second, third, fourth, fifth, or sixth protein of interest to form a fusion protein.

In one embodiment, a nucleic acid encodes a non-natural chromo- or fluorescent protein, wherein the chromo- or fluorescent protein comprises a polypeptide sequence comprising any of SEQ ID NOS:1-99, 161, 171, 175, 177, 179, 181, 183, 185, 187, 189, 213, 215, 217, 219 or 483-510. In certain embodiments, the nucleic acid encodes a non-natural chromo- or fluorescent protein, wherein the chromo- or fluorescent protein comprises a polypeptide sequence comprising 5, 6, 7, 8, 9, 10, 11, 12, 13, 14, 15, 16, 17, 18, 19, 20, 21, 22, 23, 24, 25, 26, 27, 28, 29, 30, 31 32, 33, 34, 35, 36, 37, 38, 39, 40, 41, 42, 43, 44, 45, 46, 47, 48, 49, or 50 or more contiguous amino acids of any of SEQ ID NOS: 1-99, 161, 171, 175, 177, 179, 181, 183, 185, 187, 189, 213, 215, 217, 219 or 483-510.

In one embodiment, a nucleic acid encodes a non-natural chromo- or fluorescent protein, wherein the chromo- or fluorescent protein comprises a polypeptide sequence comprising any of SEQ ID NOS:163, 165, 167, 169, 173, 191, 193, 195, 197, 199, 201, 203, 205, 207, 209, 211, 221, or 223. In certain embodiments, the nucleic acid encodes a non-natural chromo- or fluorescent protein, wherein the chromo- or fluorescent protein comprises a sequence comprising 5, 6, 7, 8, 9, 10, 11, 12, 13, 14, 15, 16, 17, 18, 19, 20, 21, 22, 23, 24, 25, 26, 27, 28, 29, 30, 31 32, 33, 34, 35, 36, 37, 38, 39, 40, 41, 42, 43, 44, 45, 46, 47, 48, 49, or 50 or more contiguous amino acids of any of SEQ ID NOS:163, 165, 167, 169, 173, 191, 193, 195, 197, 199, 201, 203, 205, 207, 209, 211, 221, or 223.

In certain embodiments, a nucleic acid encodes a non-natural chromo- or fluorescent protein, wherein the nucleic acid sequence comprises any of SEQ ID NOS:160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, or 222. In certain embodiments, the nucleic acid encodes a non-natural chromo- or fluorescent protein, wherein the nucleic acid sequence comprises at least 25, 30, 35, 40, 45, 50, 55, 60, 65, 70, 75, 100, 125, 150, 175, 200, 225, 250, 275, 300, 325, 350, 375, 400, 425, 450, 475, 500, 525, 550, 575, 600, or 625 or more contiguous bases of any of SEQ ID NOS:160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, or 222.

In certain embodiments, a nucleic acid encodes a non-natural chromo- or fluorescent protein, wherein the nucleic acid sequence comprising any of SEQ ID NOs:228-323. In certain embodiments, the nucleic acid encodes a non-natural chromo- or fluorescent protein, wherein the nucleic acid sequence comprises at least 25, 30, 35, 40, 45, 50, 55, 60, 65, 70, 75, 100, 125, 150, 175, 200, 225, 250, 275, 300, 325, 350, 375, 400, 425, 450, 475, 500, 525, 550, 575, 600, or 625 or more contiguous bases of any of SEQ ID NOS:228-323 or 512-545.

In certain embodiments, the polypeptide encoding the protein has a sequence identity of at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 96%, at least 97%, at least 98%, or at least 99% with any one of SEQ ID NOS: 1-99, 161, 171, 175, 177, 179, 181, 183, 185, 187, 189, 213, 215, 217, 219 or 483-510.

In certain embodiments, the nucleic acid encodes a non-natural chromo- or fluorescent protein, wherein the nucleic acid has a sequence identity of at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 96%, at least 97%, at least 98%, or at least 99% with any one of SEQ ID NOS: 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, or 228-323.

In certain embodiments, the nucleic acid encodes a non-natural chromo- or fluorescent protein, wherein the protein has an absorbance maximum ranging from about 300 to 800 nm. In certain embodiments, the nucleic acid encodes a non-natural chromo- or fluorescent protein, wherein the protein has an absorbance maximum ranging from about 350 to 650 nm. In certain embodiments, the nucleic acid encodes a non-natural chromo- or fluorescent protein, wherein the protein has an absorbance maximum ranging from about 400 to 600 nm. In certain embodiments, the nucleic acid encodes a non-natural chromo- or fluorescent protein, wherein the protein has an absorbance maximum ranging from about 400 to 800 nm. In certain embodiments, the nucleic acid encodes a non-natural chromo- or fluorescent protein, wherein the protein has an absorbance maximum ranging from about 425 to 775 nm. In certain embodiments, the nucleic acid encodes a non-natural chromo- or fluorescent protein, wherein the protein has an absorbance maximum ranging from about 450 to 750 nm.

In certain embodiments, the chromo- or fluorescent proteins of this invention contain a consensus sequence comprising SEQ ID NO: 546, 547, 548, 549, 550, 551, 552, 553, 554, 555, or 556 wherein X is any amino acid.

In certain embodiments, an expression cassette comprises a transcriptional initiation region functional in an expression host and a nucleic acid sequence that encodes a polypeptide comprising a non-natural chromo- or fluorescent protein, wherein the chromo- or fluorescent protein is as described herein. In certain embodiments, the expression cassette is expressed in a host cell. In certain embodiments the host cell is a prokaryotic cell, in certain embodiments the host cell is *E coli*, in certain embodiments the host cell is a non-photosynthetic microorganism having the ability to use a C1 Substrate as a source of energy, whether or not such C1 Substrate is the sole source of energy for such microorganism. As used herein, a "C1 Substrate" is an organic compound containing at least one carbon atom that lacks carbon-to-carbon bonds, including without limitation syngas, natural gas, unconventional natural gas, methane, methanol, formaldehyde, formic acid (formate), carbon monoxide, carbon dioxide, methylated amines (e.g., methylamine, dimethylamine or trimethylamine), methylated thiols, methyl halogens (e.g., bromomethane, chloromethane, iodomethane or dichloromethane) and cyanide. In certain embodiments the host cell is selected from the following organisms: *Methylomonas, Methylobacter, Methylococcus, Methylosinus, Methylocystis, Methylomicrobium, Methanomonas, Methylophilus, Methylobacillus, Methylobacterium, Hyphomicrobium, Xanthobacter, Paracoccus, Nocardia, Arthrobacter, Rhodopseudomonas, Hansenula, Torulopsis, Rhodotorula, Moorella, Pyrococcus, Eubacterium, Desulfobacterium, Carboxydothermus, Acetogenium, Acetobacterium, Acetoanaerobium, Butyribaceteriumm, Peptostreptococcus, Yarrowia, Yarrowia lipolytica, Candida lipolytica, Clostridium autoethanogenum, Clostridium llungdahli, Clostridium ragsdalei, Clostridium carboxydivorans, Butyribacterium methylotrophicum, Clostridium woodii, Clostridium neopropanologen, Bacillus subtilis, Bacillus licheniformis, Pseudomonas fluorescens, Leishmania, Kluyveromyces, Corynebacterium, Aspergillus, Trichoderma, Streptomyces, Penicillium* and *Rhizopus*.

In certain embodiments the host cell is a mammalian cell or an insect cell or a plant cell or a yeast cell. In certain embodiments the host cell is the yeast *Pichia pastoris* (*K. pastoris*). In certain embodiments, the color or fluorescence of the host cell is used to assess the expression level of the polypeptide comprising the chromo- or fluorescent protein.

In certain embodiments, the expression vector further comprises a linker sequence comprising a sequence encoding a cis-acting hydrolase element (CHYSEL) or a 2A peptide sequence interposed between the first and the second nucleic acid sequences. In certain embodiments the first nucleic acid sequence is 5' of the linker sequence and the second nucleic acid sequence is 3' of the linker sequence; in certain embodiments the first nucleic acid sequence is 3' of the of the linker sequence and the second nucleic acid sequence is 5' of the linker sequence. In certain embodiments, the expression cassette is expressed in a host cell. In certain embodiments the host cell is a mammalian cell or an insect cell or a plant cell or a yeast cell. In certain embodiments the host cell is the yeast *Pichia pastoris* (*K. pastoris*).

In certain embodiments, an expression vector comprises a transcriptional initiation sequence, a first nucleic acid sequence comprising a sequence that encodes a polypeptide comprising a first non-natural chromo- or fluorescent protein, wherein the chromo- or fluorescent protein is as described herein, and a second nucleic acid sequence that encodes a second polypeptide. In certain embodiments the first nucleic acid sequence is 5' of the second nucleic acid sequence, in certain embodiments the first nucleic acid sequence is 3' of the second nucleic acid sequence.

In certain embodiments, the color or fluorescence of the host cell is used to determine the expression of the first chromo- or fluorescent protein. In certain embodiments, the expression of the first chromo- or fluorescent protein in the host cell is used to determine the expression of the second polypeptide. In certain embodiments the expression of the first colored or fluorescent protein is used to identify host cells that express preferred levels of the second polypeptide. In certain embodiments, the preferred level of expression of the second polypeptide is a high level of polypeptide. In certain embodiments, the preferred expression of the second polypeptide is a low level of the polypeptide. In some embodiments the second polypeptide is secreted from the cell. In certain embodiments, the secreted polypeptide is a cutinase comprising the amino acid sequence of SEQ ID NO:227 or the nucleic acid sequence of SEQ ID NO:226.

In some embodiments the second polypeptide is within the cytoplasm of the cell. In certain embodiments, the second nucleic acid encodes a polypeptide comprising an antibody, an antibody heavy chain, an antibody light chain, a single chain antibody, a transcription factor, a receptor, a growth factors (any of the PDGFs, EGFs, FGFs, SCF, HGF, TGFs, TNFs, insulin, IGFs, LIFs, oncostatins, and CSFs), an immunomodulator, a peptide hormone, a cytokine, an integrin, an interleukin, an adhesion molecule, a thrombomodulatory molecule, a protease inhibitor, an angiostatin, a defensin, a differentiation antigen, an interferon, a chemokine, an antigen including those from infectious viruses and organisms, an oncogene product, thrombopoietin, erythropoietin, tissue plasminogen activator, a protease, a polymerase, a depolymerase, a kinase, a phosphatase, a cyclin, a cyclin-dependent kinase, a glycosidase, a transferase, a glycosyl transferase, a polysaccharide degrading enzyme, a ligninase, a xylanase, a cellulase, an endonuclease, an exonuclease, a methylase, a methyl transferase, a polyketide synthase, a non-ribosomal peptide synthase, an insecticidal protein, a cytochrome P450, a lipase, an esterase, a cutinase, a terpene cyclase, an enzyme, an antigen, a ligand, a polyketide synthase, a therapeutic protein.

In some embodiments, an expression vector comprises a transcriptional initiation sequence and a first nucleic acid sequence encoding a first polypeptide sequence that comprises a non-natural chromo- or fluorescent protein, wherein the chromo- or fluorescent protein is described herein. In certain embodiments, the expression cassette is integrated into the genome of a host cell. In certain embodiments, the color or fluorescence of the host cell is used to assess the expression of the first polypeptide from an expression cassette that is integrated into the genome of the host cell. In certain embodiments the expression of the colored or fluorescent protein is used to identify host cells which have integrated the expression cassette into parts of the host cell's genome that are favorable for expression of the first polypeptide. In certain embodiments the host cell is a mammalian cell or an insect cell or a plant cell or a yeast cell. In certain embodiments the host cell is the yeast *Pichia pastoris* (*K. pastoris*).

In certain embodiments, an expression vector comprises a transcriptional initiation sequence, a first nucleic acid sequence comprising a sequence that encodes a polypeptide comprising any non-natural chromo- or fluorescent protein as described herein, and a second nucleic acid sequence encoding a second polypeptide. In certain embodiments, the expression vector further comprises a linker sequence interposed between the first and the second nucleic acid sequences.

In certain embodiments, the linker sequence comprises an internal ribosomal entry site (IRES). In certain embodiments, the linker sequence comprises an IRES sequence that is shown in SEQ ID NO: 459. In certain embodiments, the linker sequence comprises a sequence encoding a cis-acting hydrolase element (CHYSEL) or a 2A peptide sequence. In certain embodiments, the linker sequence comprises a CHYSEL or 2A peptide sequence encoding an amino acid sequence that is any of SEQ ID NOS: 100-159 or 481-482. In certain embodiments, the linker sequence comprises a CHYSEL or 2A peptide sequence encoded by the DNA sequence that is any of SEQ ID NOS: 457-458, 470-476, 480 or 511.

In some embodiments an expression cassette comprising a linker sequence, a first polynucleotide encoding a first polypeptide, and a second polynucleotide encoding a second polypeptide is introduced into a host cell. In certain embodiments the first polypeptide comprises a chromo- or fluorescent protein. In certain embodiments the color or fluorescence of the first polypeptide that is expressed in the host cell is used to determine the expression level of the second polypeptide. In certain embodiments the expression of the colored or fluorescent protein is used to identify host cells that express a preferred level of the second polypeptide. In certain embodiments the preferred level is a high level of protein. In certain embodiments the preferred level is a low level or a moderate level of protein. In certain embodiments host cells which are expressing preferred levels of the second polypeptide are selected using a flow cytometer or a microscope. In some embodiments, the host cell is a mammalian cell or a plant cell or an insect cell or a yeast cell.

Expression of a protein of interest can be assessed in a mammalian cell by monitoring the expression of a fluorescent protein by visible fluorescence. A single expression construct polynucleotide encodes the protein of interest, an IRES sequence and a fluorescent protein. Cells with higher expression of the protein of interest can be identified by selecting cells that produce the most fluorescence, either by visual inspection under a microscope, or by flow cytometry. It may be particularly advantageous if the expression construct is flanked by sequences that direct integration into the chromosome using an integrase or a recombinase.

In certain embodiments, an expression vector further comprises sequences to facilitate integration of an expression cassette into the genome of an expression host. In certain embodiments, these integration-facilitating sequences comprise a TTAA-target site specific insertion element. In certain embodiments the integration-facilitating sequences are recognized by an integrase, a recombinase or a transposase, in certain embodiments said integrase is a piggyBac integrase. In certain embodiments said expression vector further comprises a gene encoding said integrase. In certain embodiments the expression vector sequence is any of SEQ ID NOS: 460-462.

In certain embodiments, an expression vector further comprises Lentiviral LTR (long terminal repeats) to facilitate integration of an expression cassette into the genome of an expression host. In certain embodiments the expression vector sequence is any of SEQ ID NOS: 463-465.

In certain embodiments, an expression vector further comprises the expression enhancement elements woodchuck hepatitis post-transcriptional regulatory element (WPRE) and scaffold attachment regions (SARs). In certain embodiments the expression vector sequence is any of SEQ ID NOS: 460-465.

In certain embodiments, a nucleic acid that encodes any non-natural chromo- or fluorescent protein as described herein is used to quantitatively assess the level of transcriptional initiation by a promoter.

In certain embodiments, a nucleic acid that encodes any non-natural chromo- or fluorescent protein as described herein is used to quantitatively assess the level of translational initiation of a 5' untranslated region or a ribosome binding site.

In certain embodiments, a nucleic acid that encodes any non-natural chromo- or fluorescent protein as described herein is used to quantitatively assess the level of expression from an extrachromosomal genetic construct.

In certain embodiments, a nucleic acid that encodes any non-natural chromo- or fluorescent protein as described herein is used to quantitatively assess the level of expression from a genomically integrated genetic construct.

In certain embodiments, a nucleic acid that encodes any non-natural chromo- or fluorescent protein as described herein is used to determine the localization of a protein encoded by a second nucleic acid in a host comprising fusing a first nucleic acid of claim 1 in-frame to the second nucleic acid, transfecting a host with the first and second fused nucleic acid, and detecting the chromo- or fluorescent protein encoded by the first nucleic acid.

In certain embodiments, a multicistronic vector comprises a nucleic acid that encodes any non-natural chromo- or fluorescent protein as described herein.

In certain embodiments, a nucleic acid encoding any non-natural chromo- or fluorescent protein as described herein, is used in an energy transfer experiment, wherein the energy transfer experiment is selected from the group consisting of fluorescence resonance energy transfer (FRET), luminescence resonance energy transfer (LRET), and bioluminescence resonance energy transfer (BRET).

In certain embodiments, a kit comprises a nucleic acid that encodes any non-natural chromo- or fluorescent protein as described herein and instructions for using the nucleic acid.

In certain embodiments, the nucleic acid that encodes any non-natural chromo- or fluorescent protein as described herein is used in a fluorescence resonance energy transfer (FRET) assay. In certain embodiments the assay comprises: a set of probes comprising at least a first and a second molecular probe, each molecular probe able to specifically bind a molecule of interest and each molecular probe associated with a dye wherein, together, the dyes allow energy transfer, wherein at least one molecular probe comprises a reactive group to modulate the spatial organization of the molecular probes after binding to the molecule of interest; wherein the reactive group is not involved in binding to the molecule of interest; and wherein at least one of the dyes is encoded by a nucleic acid that encodes any non-natural chromo- or fluorescent protein as described herein.

In certain embodiments, the nucleic acid that encodes any non-natural chromo- or fluorescent protein as described herein is used as a detection probe. In certain embodiments, a pair of probes for detecting a gene comprises: (a) a pair of primers consisting of a first primer having a 3'-end, and a second primer having a 5'-end, (b) wherein the first primer is labeled with an energy donor at the 3'-end and the second primer is labeled with an energy acceptor at the 5'-end, (c) wherein the primers satisfy the following conditions when the probes are hybridized with gene (i) the 3'-end of the first primer and the 5'-end of the second primer are close to each other when hybridized with the gene; and (ii) the energy donor and the energy acceptor, when hybridized with the gene, are located within a distance at which fluorescence resonance energy transfer (FRET) between them can occur, (d) wherein at least one of the energy donor and energy acceptor is encoded by a nucleic acid that encodes any non-natural chromo- or fluorescent protein as described herein is used.

In certain embodiments, the nucleic acid that encodes any non-natural chromo- or fluorescent protein as described herein is a fusion protein. In certain embodiments, a fluorescent fusion protein indicator comprises a binding protein moiety having an analyte-binding region which binds an analyte and causes the indicator to change conformation upon exposure to the analyte and wherein the binding protein moiety further includes a peptide-binding region for binding a target peptide moiety; a linker polypeptide moiety between about 1 amino acid residue and about 30 amino acid residues in length that links the binding protein and the target peptide moiety; a target peptide moiety; a donor fluorescent protein moiety; and an acceptor fluorescent protein moiety; wherein the binding protein moiety, the linker polypeptide moiety, the target peptide moiety, the donor fluorescent protein moiety, and the acceptor fluorescent protein moiety together form a single polypeptide chain in which one of the donor fluorescent protein moiety or the acceptor fluorescent protein moiety is located at the carboxy terminus of the single polypeptide chain and the other of the donor fluorescent protein moiety or the acceptor fluorescent protein moiety is located at the amino terminus of the single polypeptide chain; wherein the donor fluorescent protein moiety and the acceptor fluorescent protein moiety change position relative to each other when the analyte binds to the analyte-binding region, altering fluorescence resonance energy transfer between the donor fluorescent protein moiety and the acceptor fluorescent protein moiety when the donor fluorescent protein moiety and the acceptor fluorescent protein moiety when the donor fluorescent protein moiety is excited; and wherein at least one of the donor fluorescent protein moiety and the acceptor fluorescent protein moiety is encoded by a Nucleic acid that encodes any non-natural chromo- or fluorescent protein as described herein.

In certain embodiments, the nucleic acid that encodes any non-natural chromo- or fluorescent protein as described herein is used for fluorescent spectroscopy. Certain embodiments comprise a method for fluorescent spectroscopy of a target substance comprising an isolated target substance, tagging said target substance with a fluorescent tag, removing excess fluorescent tag, exciting the tagged target substance with at least one pulse of radiation, said pulse having a pulse duration which is short compared to the fluorescent decay lifetime of said fluorescent tag, and detecting the fluorescence of said excited tagged target substances after the fluorescence of said ambient substances has substantially decayed;

wherein the fluorescent tag comprises a nucleic acid that encodes any non-natural chromo- or fluorescent protein as described herein.

In certain embodiments, the nucleic acid that encodes any non-natural chromo- or fluorescent protein as described herein is used for a time-resolved fluorescence immunoassay for multiple analytes. In certain embodiments, the time-resolved fluorescence immunoassay for multiple analytes, comprises the steps of: (a) forming an incubation mixture of: (i) antibodies against each analyte; (ii) a predetermined amount of fluorescently labeled analytes wherein each fluorescently labeled analyte has a different fluorescene lifetime; and (iii) a sample to be tested; (b) incubating the mixture under conditions and for a period of time sufficient for antibody and analytes to complex; and (c) determining contemporaneously the amount of each fluorescently labeled analyte bound with antibody as an indication of the amount of each corresponding analyte in the sample, by (i) exciting the fluorescently labeled analyte with a light pulse; and (ii) determining the amplitude of each fluorescence decay curve for the antibody-bound fluorescently labeled analyte by a single amplitude measurement measuring all of the fluorescence reaching the detector from the instant of excitation; wherein the fluorescently labeled analytes are labeled with a fluorophore encoded by a nucleic acid that encodes any non-natural chromo- or fluorescent protein as described herein.

Certain embodiments comprise a method of detecting a protein in a host with an antibody labeled with a chromo- or fluorescent protein encoded by a nucleic acid that encodes any non-natural chromo- or fluorescent protein as described herein, wherein the labeled antibody binds to the protein and the chromo- or fluorescent protein is detected.

In certain embodiments, a fusion protein comprises one or more proteins wherein one or more of the proteins are encoded by any non-natural chromo- or fluorescent protein as described herein. In certain embodiments, the individual proteins of the fusion protein are separated by a linker sequence. In certain embodiments the linker sequence is an IRES or a CHYSEL sequence.

In certain embodiments, changes to the nucleic acid or amino acid sequence of the non-natural chromo- or fluorescent protein as described herein may modify the properties of said chromo- or fluorescent proteins. Over the last several years, mutagenesis has been used to obtain fluorescent proteins with improved folding properties and improved kinetics of maturation (Campbell et al., PNAS 99: 12, 2002; Crameri et al., Nat Biotechnol 14: 315-319, 1996; Tasdemir et al., Prot. Eng. Design and Sel 21: 613-622, 2008). In addition, all naturally occurring colored and fluorescent proteins reported so far, especially yellow-to red fluorescent proteins are obligately tetrameric and often toxic or disruptive. Mutagenesis has been used to obtain colored or fluorescent proteins that are reduced in their tendency to multimerize and reduced in their toxicity (Campbell et al., PNAS 99: 12, 2002; Zhang et al., Nat. Methods, 2012; Zacharias et al., Science 296, 913, 2002). Colored and fluorescent proteins are often less active in the presence of acid or chloride ions. Mutagenesis has been used to increase the tolerance of colored or fluorescent proteins to environmental conditions. Mutagenesis has also been used to alter the light absorbing and emitting properties of colored or fluorescent proteins. Mutants of the non-natural chromo- or fluorescent protein as described herein, made to improve or change one or more of their biological or physical properties, are also an embodiment of the invention.

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order which is logically possible.

4. BRIEF DESCRIPTION OF THE DRAWINGS

FIG. 1 illustrates cytoplasmic color protein expression in K. pastoris transformed with various constructs, ranked empirically based on visible color ranging from no color to the brightest color. 81844 and 81845 encode non-natural yellow fluorescent proteins, 82269 and 82270 each encode a non-natural red fluorescent protein linked through a CHY-SEL sequence at its C-terminus to a non-chromogenic cutinase, 82271 encodes a non-chromogenic cutinase protein.

FIG. 2 illustrates cytoplasmic colored protein expression in K. pastoris transformed with gene constructs 81844 (SEQ ID NO: 160) and 81845 (SEQ ID NO: 162) expressing color protein alone, run on a coomasie stained gel. Bands showing color protein expression (lanes 3 and 4) can clearly be seen in the gel compared to uninduced K. pastoris negative control (lane 1).

FIG. 3 shows a schematic representation of the organization of a genetic construct comprising a transcriptional promoter driving the expression of a two polypeptides liked by a linker sequence. Either or both polypeptides may comprise colored or fluorescent proteins as described herein. The linker sequence may comprise IRES elements or 2A peptides or CHYSEL elements as described herein.

FIG. 4 illustrates expression of secreted cutinase in total cell pellets and concentrated supernatants from K. pastoris transformed with gene construct 82271 (SEQ ID NO: 168) encoding a non-chromogenic cutinase protein alone, run on a coomasie stained gel. Secreted cutinase is seen in the concentrated supernatant fractions (arrow).

FIG. 5 illustrates ranking of clones for K. pastoris transformed with constructs 82269 (SEQ ID NO: 164) and 82270 (SEQ ID NO: 166) based on color intensity assigned empirically, spanning a range of 0 to 5, with 0 being no color to 5 as the brightest color. 82269 and 82270 each encode a non-natural red fluorescent protein linked through a CHYSEL sequence at its C-terminus to a non-chromogenic cutinase.

FIG. 6 illustrates cutinase expression for high, medium and low color expresser clones in cell lysates and supernatants from K. pastoris transformed with constructs 82269 (SEQ ID NO: 164) and 82270 (SEQ ID NO: 166) encoding red fluorescent protein and secreted cutinase. Secreted cutinase is seen in the concentrated supernatant fractions.

FIG. 7 illustrates expression of colored protein in total cytoplasmic lysates from K. pastoris transformed with constructs 86197 (SEQ ID NO: 170) encoding non-natural color protein violet_1 and 86199 (SEQ ID NO: 174) encoding non-natural color protein pink orange. Lane 1 shows uninduced K. pastoris, Lanes 2 and 3 show expression of color protein bands in cell lysates of two different clones of 86197, with a higher intensity band observed for clone 11 (lane 2) corresponding with higher color expression (FIG. 8). Lanes 4 and 5 show expression of color protein bands in cell lysates of two different clones for 86199, bands of equal intensity are seen corresponding to similar color intensity observed in cell pellets (FIG. 8).

FIG. 8 illustrates shows number of clones showing low, medium, high and very high color expression in cell pellets of K. pastoris transformed with constructs 94022 (SEQ ID NO:

190) and 94024 (SEQ ID NO: 192) encoding non-natural color protein and secreted or cytoplasmic cutinase respectively in *K. pastoris*.

FIG. 9 illustrates expression of cutinase in cytoplasmic lysates and concentrated supernatants for clones picked based on color intensity for *K. pastoris* transformed with constructs 94022 (SEQ ID NO: 190) and 94024 (SEQ ID NO: 192) encoding non-natural color protein and secreted or cytoplasmic cutinase respectively in *K. pastoris*, run as a western blot. The blot was scanned using the alpha-imager from Alpha Innotech; vaccinia polymerase bands were quantitated based on density using the TotalLab software for 1D gel analysis. Band densities were plotted against clones showing low, medium or high color expression shown as a bar graph. Band intensities correspond to range of color expression, with high color expressing clones showing higher band intensity. Bands corresponding to cutinase (shown by arrow on Western blot) show increasing intensity in clones with very high color expression as seen in the bar graph (lower panel). A similar trend is observed for secreted (construct 94022) and cytoplasmic (construct 94024) cutinase expression; secreted cutinase expression was observed in construct 94022 supernatant, no expression in the cytoplasmic lysates. Cytoplasmic cutinase expression is observed in the cytoplasmic lysates of construct 94024 with no expression in the supernatant.

FIG. 10 illustrates shows the number of clones showing low, medium and high color expression from *K. pastoris* transformed with constructs 87858 (SEQ ID NO: 194) encoding non-natural color protein magenta and vaccinia polymerase, 87859 (SEQ ID NO: 196) encoding non-natural color protein pink and vaccinia polymerase and 87860 (SEQ ID NO: 198) encoding non-natural color protein purple and vaccinia polymerase in *K. pastoris*.

FIG. 11 illustrates expression of cytoplasmic Vaccinia polymerase in lysates of clones with low, medium or high color expression from *K. pastoris* transformed with constructs 87858 (SEQ ID NO: 194) encoding non-natural color protein magenta and vaccinia polymerase, 87859 (SEQ ID NO: 196) encoding non-natural color protein pink and vaccinia polymerase and 87860 (SEQ ID NO: 198) encoding non-natural color protein purple and vaccinia polymerase in *K. pastoris*, run as a western blot. The blot was scanned using the alpha-imager from Alpha Innotech; vaccinia polymerase bands were quantitated based on density using the TotalLab software for 1D gel analysis. Band densities were plotted against clones showing low, medium or high color expression shown as a bar graph. Band intensities correspond to range of color expression, with high color expressing clones showing higher band intensity.

FIG. 12 shows numbers of clones showing low, medium and high color expression determined empirically in cell pellets of *K. pastoris* transformed with constructs 84674 (SEQ ID NO: 200) encoding non-natural color protein pink with mouse 2A and secreted cutinase and 84675 (SEQ ID NO: 202) encoding non-natural color protein with EMCV and secreted cutinase in *K. pastoris*.

FIG. 13 illustrates cutinase expression in total cell lysates and concentrated supernatants from *K. pastoris* transformed with constructs 84674 (SEQ ID NO: 200) encoding non-natural color protein pink 2 linked by TAV 2A peptide to secreted cutinase, and 84675 (SEQ ID NO: 202) encoding non-natural color protein pink 2 linked by EMCV 2A peptide to secreted cutinase, run as a western blot. Cutinase bands (arrow) are observed in the supernatant fractions, a higher intensity cutinase band is observed in supernatant for construct 84675 correlating well with the clone showing medium color expression, a lower intensity band is seen for construct 84674 that correlates well with low color expression observed.

FIG. 14 shows numbers of clones showing low, medium and high color expression in *K. pastoris* transformed with constructs 84676 (SEQ ID NO: 204) encoding non-natural color protein purple with mouse 2A and secreted cutinase and 84677 (SEQ ID NO: 206) encoding non-natural color protein purple with EMCV and secreted cutinase in *K. pastoris*.

FIG. 15 illustrates cutinase expression in concentrated supernatants from *K. pastoris* transformed with constructs 84676 (SEQ ID NO: 204) encoding non-natural color protein purple with mouse 2A and secreted cutinase and 84677 (SEQ ID NO: 206) encoding non-natural color protein purple with EMCV and secreted cutinase, run as coomasie stained gels (not shown) for constructs 84676 and 84677. Gels were scanned using the alpha-imager from Alpha Innotech; cutinase bands were quantitated based on density using the TotalLab software for 1D gel analysis. Band densities were plotted against clones showing low, medium or high color expression shown as a bar graph. Band intensities correspond to range of color expression, with high color expressing clones showing higher band intensity.

FIG. 16 shows number of clones showing low, medium and high color expression in *K. pastoris* transformed with construct 84681 (SEQ ID NO: 210) encoding non-natural fluorescent protein green with EMCV and secreted cutinase. FIG. 20.

FIG. 17 illustrates cutinase expression in lysates and concentrated supernatants from *K. pastoris* transformed with construct 84681 (SEQ ID NO: 210) encoding non-natural fluorescent protein green with EMCV and secreted cutinase, run as a coomasie stained gel (upper panel). Cutinase bands of increasing intensity (shown by arrow) are observed in supernatants of clones corresponding to low (L), medium (M) or high (H) color expression. Gel was scanned using the alpha-imager from Alpha Innotech; cutinase bands were quantitated based on density using the TotalLab software for 1D gel analysis. Band densities were plotted against clones showing low, medium or high color expression shown as a bar graph (lower panel).

FIG. 18 shows number of clones showing low, medium and high color expression from *K. pastoris* transformed with constructs 95814 (SEQ ID NO: 212 encoding non-natural fluorescent protein red_6, 95815 (SEQ ID NO: 214) encoding non-natural fluorescent protein red_3, 95816 (SEQ ID NO: 216) encoding non-natural fluorescent protein red_4 and 95817 (SEQ ID NO: 218) encoding non-natural fluorescent protein red_5 in *K. pastoris*.

FIG. 19 shows number of clones showing low, medium and high color expression from *K. pastoris* transformed with constructs 95951 (SEQ ID NO: 220) encoding non-natural color protein and secreted cutinase, 95952 (SEQ ID NO: 222) encoding non-natural color protein and secreted cutinase, and 95954 (SEQ ID NO: 226) encoding secreted cutinase only in *K. pastoris*.

FIG. 20 illustrates expression of cutinase in cell lysates and concentrated supernatants from *K. pastoris* transformed with constructs 95952 (SEQ ID NO: 222) encoding non-natural color protein and secreted cutinase, 95951 (SEQ ID NO: 220) encoding non-natural color protein and secreted cutinase and 95954 (SEQ ID NO: 226) encoding secreted cutinase only; cell lysates and supernatants were run on a coomasie stained gel or western blots for clones of low (L), medium (M) or high (H) color expression. 95951 and 95952 clones show expression of cutinase (arrow) in supernatants with higher band intensities corresponding well with higher color expression.

95954 showed cutinase expression in the supernatant fraction. Gels were scanned using the alpha-imager from Alpha Innotech; cutinase bands were quantitated based on density using the TotalLab software for 1D gel analysis. Band densities were plotted against clones showing low, medium or high color expression shown as a bar graph (lower panel).

FIG. 21 illustrates correlation between intensity of DasherGFP expression and fluorescence intensity in E. coli and HEK293 cells: FIG. 21A shows DasherGFP expression estimated from band intensity on gel. FIG. 21B depicts a comparison of total fluorescence to DasherGFP band intensity from a coomasie stained gel. A good correlation is observed for DasherGFP band intensity and total fluorescence with a $R^2=0.99$. FIG. 21C depicts expression of DasherGFP variants (SEQ ID NOS: 228-323) in E. coli and HEK293 cells. The effects of different gene design parameters on expression can be explored by using different sequences to encode the same non-natural fluoro- or chromogenic protein.

5. DETAILED DESCRIPTION OF THE INVENTION

5.1 Definitions

Figure 2:
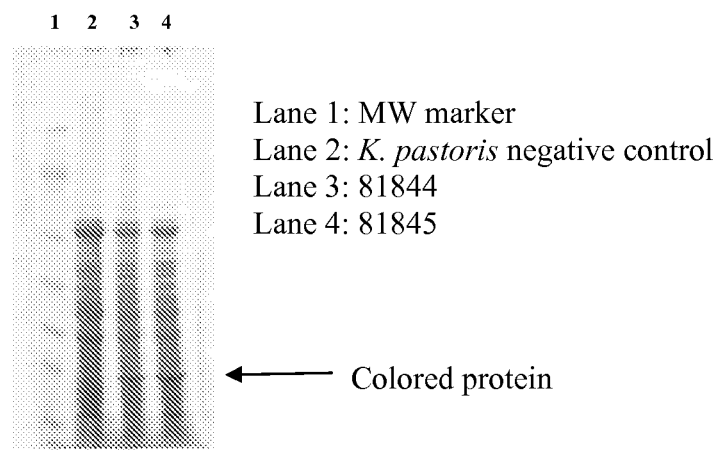

Use of the singular forms "a," "an," and "the" include plural references unless the context clearly dictates otherwise. Thus, for example, reference to "a polynucleotide" includes a plurality of polynucleotides, reference to "a substrate" includes a plurality of such substrates, reference to "a variant" includes a plurality of variants, and the like.

Terms such as "connected," "attached," "linked," and "conjugated" are used interchangeably herein and encompass direct as well as indirect connection, attachment, linkage or conjugation unless the context clearly dictates otherwise. Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the invention. Where a value being discussed has inherent limits, for example where a component can be present at a concentration of from 0 to 100%, or where the pH of an aqueous solution can range from 1 to 14, those inherent limits are specifically disclosed. Where a value is explicitly recited, it is to be understood that values which are about the same quantity or amount as the recited value are also within the scope of the invention. Where a combination is disclosed, each subcombination of the elements of that combination is also specifically disclosed and is within the scope of the invention. Conversely, where different elements or groups of elements are individually disclosed, combinations thereof are also disclosed. Where any element of an invention is disclosed as having a plurality of alternatives, examples of that invention in which each alternative is excluded singly or in any combination with the other alternatives are also hereby disclosed; more than one element of an invention can have such exclusions, and all combinations of elements having such exclusions are hereby disclosed.

Unless defined otherwise herein, all technical and scientific terms used herein have the same meaning as commonly understood by one of ordinary skill in the art to which this invention belongs. Singleton, et al., *Dictionary of Microbiology and Molecular Biology*, 2nd Ed., John Wiley and Sons, New York (1994), and Hale & Marham, *The Harper Collins Dictionary of Biology*, Harper Perennial, NY, 1991, provide one of skill with a general dictionary of many of the terms used in this invention. Although any methods and materials similar or equivalent to those described herein can be used in the practice or testing of the present invention, the preferred methods and materials are described. Unless otherwise indicated, nucleic acids are written left to right in 5' to 3' orientation; amino acid sequences are written left to right in amino to carboxy orientation, respectively. The terms defined immediately below are more fully defined by reference to the specification as a whole.

The terms "polynucleotide," "oligonucleotide," "nucleic acid" and "nucleic acid molecule" and "gene" are used interchangeably herein to refer to a polymeric form of nucleotides of any length, and may comprise ribonucleotides, deoxyribonucleotides, analogs thereof, or mixtures thereof. This term refers only to the primary structure of the molecule. Thus, the term includes triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the terms "polynucleotide," "oligonucleotide," "nucleic acid" and "nucleic acid molecule" include polydeoxyribonucleotides (containing 2-deoxy-D-ribose), polyribonucleotides (containing D-ribose), including tRNA, rRNA, hRNA, siRNA and mRNA, whether spliced or unspliced, any other type of polynucleotide which is an N- or C-glycoside of a purine or pyrimidine base, and other polymers containing nonnucleotidic backbones, for example, polyamide (e.g., peptide nucleic acids ("PNAs")) and polymorpholino (commercially available from the Anti-Virals, Inc., Corvallis, Oreg., as Neugene) polymers, and other synthetic sequence-specific nucleic acid polymers providing that the polymers contain nucleobases in a configuration which allows for base pairing and base stacking, such as is found in DNA and RNA. There is no intended distinction in length between the terms "polynucleotide," "oligonucleotide," "nucleic acid" and "nucleic acid molecule," and these terms are used interchangeably herein. These terms refer only to the primary structure of the molecule. Thus, these terms include, for example, 3'-deoxy-2',5'-DNA, oligodeoxyribonucleotide N3' P5' phosphoramidates, 2'-O-alkyl-substituted RNA, double- and single-stranded DNA, as well as double- and single-stranded RNA, and hybrids thereof including for example hybrids between DNA and RNA or between PNAs and DNA or RNA, and also include known types of modifications, for example, labels, alkylation, "caps," substitution of one or more of the nucleotides with an analog, internucleotide modifications such as, for example, those with uncharged linkages (e.g., methyl phosphonates, phosphotriesters, phosphoramidates, carbamates, etc.), with negatively charged linkages (e.g., phosphorothioates, phosphorodithioates, etc.), and with positively charged linkages (e.g., aminoalkylphosphoramidates, aminoalkylphosphotriesters), those containing pendant moieties, such as, for example, proteins (including enzymes (e.g. nucleases), toxins, antibodies, signal peptides, poly-L-lysine, etc.), those with intercalators (e.g., acridine, psoralen, etc.), those containing chelates (of, e.g., metals, radioactive metals, boron, oxidative metals, etc.), those containing alkylators, those with modified linkages (e.g., alpha anomeric nucleic acids, etc.), as well as unmodified forms of the polynucleotide or oligonucleotide.

The terms "polynucleotide," "oligonucleotide," "nucleic acid" and "nucleic acid molecule" and "gene" refer to the entire sequence or gene or a fragment thereof. The fragment thereof can be a functional fragment.

Where the polynucleotides are to be used to express encoded proteins, nucleotides that can perform that function or which can be modified (e.g., reverse transcribed) to perform that function are used. Where the polynucleotides are to be used in a scheme that requires that a complementary strand be formed to a given polynucleotide, nucleotides are used which permit such formation.

It will be appreciated that, as used herein, the terms "nucleoside" and "nucleotide" will include those moieties which contain not only the known purine and pyrimidine bases, but also other heterocyclic bases which have been modified. Such modifications include methylated purines or pyrimidines, acylated purines or pyrimidines, or other heterocycles. Modified nucleosides or nucleotides can also include modifications on the sugar moiety, e.g., where one or more of the hydroxyl groups are replaced with halogen, aliphatic groups, or is functionalized as ethers, amines, or the like.

Standard A-T and G-C base pairs form under conditions which allow the formation of hydrogen bonds between the N3-H and C4-oxy of thymidine and the N1 and C6-NH2, respectively, of adenosine and between the C2-oxy, N3 and C4-NH2, of cytidine and the C2-NH$_2$, N'—H and C6-oxy, respectively, of guanosine. Thus, for example, guanosine (2-amino-6-oxy-9-β-D-ribofuranosyl-purine) may be modified to form isoguanosine (2-oxy-6-amino-9-.beta.-D-ribofuranosyl-purine). Such modification results in a nucleoside base which will no longer effectively form a standard base pair with cytosine. However, modification of cytosine (1-β-D-ribofuranosyl-2-oxy-4-amino-pyrimidine) to form isocytosine (1-β-D-ribofuranosyl-2-amino-4-oxy-pyrimidine-) results in a modified nucleotide which will not effectively base pair with guanosine but will form a base pair with isoguanosine (U.S. Pat. No. 5,681,702 to Collins et al., hereby incorporated by reference in its entirety). Isocytosine is available from Sigma Chemical Co. (St. Louis, Mo.); isocytidine may be prepared by the method described by Switzer et al. (1993) Biochemistry 32:10489-10496 and references cited therein; 2'-deoxy-5-methyl-isocytidine may be prepared by the method of Tor et al., 1993, J. Am. Chem. Soc. 115:4461-4467 and references cited therein; and isoguanine nucleotides may be prepared using the method described by Switzer et al., 1993, supra, and Mantsch et al., 1993, Biochem. 14:5593-5601, or by the method described in U.S. Pat. No. 5,780,610 to Collins et al., each of which is hereby incorporated by reference in its entirety. Other nonnatural base pairs may be synthesized by the method described in Piccirilli et al., 1990, Nature 343:33-37, hereby incorporated by reference in its entirety, for the synthesis of 2,6-diaminopyrimidine and its complement (1-methylpyrazolo-[4,3]pyrimidine-5,7-(4H, 6H)-dione. Other such modified nucleotidic units which form unique base pairs are known, such as those described in Leach et al. (1992) J. Am. Chem. Soc. 114:3675-3683 and Switzer et al., supra.

The phrase "DNA sequence" refers to a contiguous nucleic acid sequence. The sequence can be either single stranded or double stranded, DNA or RNA, but double stranded DNA sequences are preferable. The sequence can be an oligonucleotide of 6 to 20 nucleotides in length to a full length genomic sequence of thousands or hundreds of thousands of base pairs.

The term "protein" refers to contiguous "amino acids" or amino acid "residues." Typically, proteins have a function. However, for purposes of this invention, proteins also encompass polypeptides and smaller contiguous amino acid sequences that do not have a functional activity. The functional proteins of this invention include, but are not limited to, esterases, dehydrogenases, hydrolases, oxidoreductases, transferases, lyases, ligases, receptors, receptor ligands, cytokines, antibodies, immunomodulatory molecules, signalling molecules, fluorescent proteins and proteins with insecticidal or biocidal activities. Useful general classes of enzymes include, but are not limited to, proteases, cellulases, lipases, hemicellulases, laccases, amylases, glucoamylases, esterases, lactases, polygalacturonases, galactosidases, ligninases, oxidases, peroxidases, glucose isomerases, nitrilases, hydroxylases, polymerases and depolymerases. In addition to enzymes, the encoded proteins which can be used in this invention include, but are not limited to, transcription factors, antibodies, receptors, growth factors (any of the PDGFs, EGFs, FGFs, SCF, HGF, TGFs, TNFs, insulin, IGFs, LIFs, oncostatins, and CSFs), immunomodulators, peptide hormones, cytokines, integrins, interleukins, adhesion molecules, thrombomodulatory molecules, protease inhibitors, angiostatins, defensins, cluster of differentiation antigens, interferons, chemokines, antigens including those from infectious viruses and organisms, oncogene products, thrombopoietin, erythropoietin, tissue plasminogen activator, and any other biologically active protein which is desired for use in a clinical, diagnostic or veterinary setting. All of these proteins are well defined in the literature and are so defined herein. Also included are deletion mutants of such proteins, individual domains of such proteins, fusion proteins made from such proteins, and mixtures of such proteins; particularly useful are those which have increased half-lives and/or increased activity.

As used herein, the terms "polypeptide" and "protein" refer to the full length polypeptide and protein or a fragment thereof. The fragment thereof may be a functional fragment. The fragment thereof may be an antibody binding fragment.

"Polypeptide" and "protein" are used interchangeably herein and include a molecular chain of amino acids linked through peptide bonds. The terms do not refer to a specific length of the product. Thus, "peptides," "oligopeptides," and "proteins" are included within the definition of polypeptide. The terms include polypeptides containing in co- and/or post-translational modifications of the polypeptide made in vivo or in vitro, for example, glycosylations, acetylations, phosphorylations, PEGylations and sulphations. In addition, protein fragments, analogs (including amino acids not encoded by the genetic code, e.g. homocysteine, ornithine, p-acetylphenylalanine, D-amino acids, and creatine), natural or artificial mutants or variants or combinations thereof, fusion proteins, derivatized residues (e.g. alkylation of amine groups, acetylations or esterifications of carboxyl groups) and the like are included within the meaning of polypeptide.

"Amino acids" or "amino acid residues" may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

The phrase "2A peptide" refers to any 2A peptide or 2A-like peptide. CHYSEL is a non-limiting example of a "2A peptide." These short sequences mediate co-translational cleavage of the peptides upstream and downstream from the 2A site, allowing production of two different proteins from a single transcript in equimolar amounts.

The term "expression system" refers to any in vivo or in vitro biological system that is used to produce one or more protein encoded by a polynucleotide.

The term "annealing temperature" or "melting temperature" or "transition temperature" refers to the temperature at which a pair of nucleic acids is in a state intermediate between being fully annealed and fully melted. The term refers to the behavior of a population of nucleic acids: the "annealing temperature" or "melting temperature" or "transition temperature" is the temperature at which 50% of the molecules are annealed and 50% are separate. Annealing temperatures can be determined experimentally. There are also methods well known in the art for calculating these temperatures.

The term "translation" refers to the process by which a polypeptide is synthesized by a ribosome 'reading' the sequence of a polynucleotide.

The term "selectable protein" refers to a protein that provides a physical, chemical or biological method for selecting cells on the basis of how much of the selectable protein is expressed.

The term "coupling element" refers to a DNA sequence that allows the expression of a first polypeptide to be linked to the expression of a second polypeptide. Internal ribosome binding sites and cis-acting hydrolase elements are examples of coupling elements.

The terms "chromoprotein" and "chromophore" are used interchangeably. They refer to molecules that are characterized by colors that can be detected in visible light. Chromogenic fragments or fragments of chromoproteins that exhibit the characteristic color of the chromoprotein are included in the meaning of chromoprotein.

The term "fluorophore" refers to a molecule or fragment thereof that absorbs energy at one wavelength and re-emits energy at another wavelength. Fluorescent properties that can be measured include fluorescence intensity, fluorescence lifetime, emission spectrum characteristics, energy transfer, and the like.

The term "host" refers to refers to any prokaryotic or eukaryotic (e.g., mammalian, insect, yeast, plant, avian, animal, etc.) organism that is a recipient of a replicable expression vector, cloning vector or any nucleic acid molecule. As used herein, the terms "host," "host cell," and "expression host" be used interchangeably.

The phrase "predetermined time period" refers to a specified amount of time. A "predetermined period of time" can be on the order of seconds, minutes, hours, days, weeks, or months. For example, a "predetermined time period" can be between 1 and 59 minutes, or any increment between 1 and 2 hours, or any increment between 2 and 4 hours, or any increment between 4 and 6 hours, or any increment between 6 and 12 hours, or any increment between 12 and 24 hours, or any increment between 1 day and 2 days, or any increment between 2 days and 4 days, and any increment between 4 days and 7 days, and any increment between 1 week and 4 weeks, and any increment between 1 month and 12 months, or any combination of incremental time periods therein.

The genus *Pichia* and *Komagataella* are used interchangeably. *Pichia pastoris P. pastoris, K. pastoris K. phaffii* and *Komagataella phaffii* are all used to denote the same organism.

5.2 Selectable Proteins

One selection method is to use a protein whose production confers a survival advantage on the cell that expresses it. Examples include proteins that confer resistance to a toxic substance such as an antibiotic, or proteins that confer a metabolic capability such as the ability to produce a nutrient required by the cell, such as a sugar or a vitamin or an enzyme cofactor or an amino acid or nucleic acid base or a precursor to an amino acid or nucleic acid base. Other examples include proteins that confer resistance to other environmental conditions which may be artificially produced, for example a protein may cause a cell to adhere to a substrate, causing cells expressing the protein to become enriched when the substrate is subjected to a washing step. Genetic constructs that encode selectable proteins can therefore confer phenotypes to the cells that contain the constructs, which allows said cells to be selected, enriched or identified within a population of cells. Selectable proteins can therefore be used to identify cells that contain a genetic construct encoding the proteins. Additional examples include proteins that provide a compound essential for the viability of cells, for example an enzyme which converts a basic carbon source into an essential sugar needed for cell survival in media that is sugar-free.

In some instances the degree of the phenotype correlates with the amount of the selectable protein that is expressed. For example in some instances the concentration of an antibiotic that can be tolerated increases as the amount of resistance protein expressed by the cell increases; in other instances the growth rate of a cell increases as the expression of a protein catalyzing synthesis of a nutrient increases. Thus selectable proteins can be used to couple cell growth or survival to the amount of the protein that is being expressed from a genetic construct within a cell.

Another convenient selection method is to use a protein whose expression allows the cell expressing the protein to be easily recognized. Examples of such selectable proteins include proteins that are colored or fluorescent, or proteins that cause or catalyze a colored substance to be produced or consumed. The proteins listed as SEQ ID NOS: 1-99, 161, 171, 175, 177, 179, 181, 183, 185, 187, 189, 213, 215, 217, 219 or 483-510 are examples of proteins that are colored or fluorescent. Consensus sequences for these proteins derived from sequence alignment of different groups of these proteins are shown in SEQ ID NOS: 546-556. These proteins can be used to identify cells that are expressing them. These proteins can therefore be used to identify cells that contain a genetic construct encoding the proteins. The intensity of the color or fluorescence for any one of the proteins correlates with the amount of that protein that is present. Thus color or fluorescence intensity can be used to provide a measure of the amount of the protein that is being expressed from a genetic construct within a cell.

Another selection method that can be used to distinguish cells expressing a transgene in a mixed population is to produce a protein which confers resistance to a toxin. In one example, a pair of proteins is made up of toxin and antidote protein such as the *Salmonella enterica* virulence-associated protein SpvB and an antidote of a single-domain intracellular antibody. Cells producing an intracellular antibody that specifically block the enzymatic activity of SpvB are left alive whereas all other cells undergo programmed cell death due to inhibition of protein production by SpvB.

Proteins that allow host cells to maintain viability in the presence of cytotoxic antibiotics are another means to distinguish cells from their unchanged counterparts. Examples of this for mammalian cells include antibiotics such as puromycin, hygromycin, blasticidin, and phleomycin (zeocin). Further examples for yeast and plants include geneticin (G418), hygroymicin and puromycin. Additional examples for bacteria include ampicillin, kanamycin and chloramphenicol. In all examples, cells that do not express the appropriate antibiotic resistance protein undergo cell death. A specific example of this is the beta-lactamase protein, expression of which leads to resistance against the bactericidal antibiotic ampicillin.

Enzymes that have the ability to convert normally inert substrates into either chromophores or fluorescent molecules are another example of proteins that allow for selection of a specific population of cells. A widely seen example of this is the beta-galactosidase protein. When expressed in bacteria, cells that are grown in the presence of the sugar x-gal, produce a blue chromophore which stains bacterial colonies. In addition, beta-galatosidase is an example of an enzyme with the ability to convert a normally non-fluorescent substrate into a fluorescent one. In mammalian cells the non-fluorescent substrate fluorescein di-beta-D-galactopyranoside (FDG) is hydrolyzed by beta-galactosidase to produce the highly fluorescent molecule fluorescein.

An additional method of protein selection of cells involves the use of luminescence producing proteins. For example, the enzyme luciferase can produce bioluminescence when incubated in vitro or in vivo in the presence of the substrate luciferin. The release of photons can then be identified using a luminometer or even visually when the concentration of luciferase protein and activity are at sufficiently high levels.

Another method of protein selection involves the controlled interaction of two fragments of a protein that in and of themselves have no activity, but together produce an activity that can be selected, a method known as protein fragment complementation assay (PFCA). PFCA has been demonstrated in proteins that, for example, confer survival in the presence of a lethal antibiotic drug, confer bioluminescence, and confer cell survival in conditions of nutrient depletion. Examples of proteins that have successfully been utilized for PFCA include: dihydrofolate reductase (DHFR), beta-lactamase, yeast Gal4 (as in the classical yeast two-hybrid system), tobacco tech virus protease, luciferase, ubiquitin and green fluorescent protein (GFP).

Another scenario in which proteins can be used to select a highly specific population of cells is based on controlling the localization of proteins through fusion to fragments of proteins or peptides. For example, the Cre-estrogen receptor ligand binding domain (ER-LBD) fusion protein is normally sequestered in the cytoplasm due to binding of cytoplasmic heat shock proteins to the ER-LBD. Upon addition of natural or artificial ER-LBD ligand, a conformational change results in the release of the Cre-ER-LBD fusion from heat shock proteins and re-localization of the fusion protein to the nucleus. In the nucleus, Cre recombinase can remove a counter-selection cassette that is flanked by loxP sites, allowing selection of a specific population of cells.

Another category of proteins that offer a unique way of selecting cells are proteins that confer resistance to DNA damaging agents. A specific example of this is the mcrA gene from *Streptomyces*, which confers resistance to the DNA damaging agent mitomycin C.

Proteins that confer magnetization to a host cell offer another means to select a particular population of cells. An example of this is the yeast protein TCO89, when produced in high quantity in yeast cells, allows selection of cells with a magnetic field.

Lifespan of some cell types is limited to a defined amount of population doublings and/or time in culture. For example, primary diploid fibroblasts will undergo senescence, permanent growth arrest and/or die when they have divided a limited number of times in culture. In another example, if contact with substratum is lost, diploid fibroblasts will undergo anoikis or programmed cell death as a result of loss of substratum contact. Within a few days most cells will be dead as a result of anoikis. An example of a protein that allows for increased lifespan selection is the catalytic subunit of human telomerase (hTERT), which restores telomeric repeats to the ends of chromosomes. Primary cells expressing hTERT protein will undergo many population doublings and bypass senescence. Another example to avoid anoikis, is a protein that confers resistance to apoptosis such as bcl-2, that may be used for enrichment of a distinct population of cells.

Cells undergo lysis in response to rapid changes in temperature such as freeze-thawing. Proteins that allow cells to survive adverse environmental conditions that promote lysing, for e.g., protein/drug treatment, temperature change, hypotonic conditions are other instances where proteins may be used for selection. An example of this would be use of fish-derived antifreeze proteins that would allow mammalian cells to survive multiple rounds of freeze-thaw in the absence of a non-selective cryoprotectant such as dimethyl sulfoxide.

Proteins presented on the surface of cells can be accessed with antibodies and peptides as well as natural and small molecule drug products. Purification of a unique population of cells expressing ligands that recognize molecules such as antibodies may then be accomplished by tethering antibodies to a matrix, thereby allowing capture of a cell population expressing ligand from a mixed population of cells. For example, a monoclonal antibody that recognizes the CD19 receptor tethered to a column may be used to purify cells from a mixed population. Fibroblasts which normally do not express the CD19 receptor could be modified to express CD19 from a transgene. The CD19 expressing fibroblast population can be separated from a mixed fibroblast population by using a column coated with the anti-CD 19 antibody. The non-transgenic cells would not bind to the anti-CD 19 antibody and be washed away whereas the CD 19 expressing transgenic fibroblasts would remain bound to the anti-CD19 antibody.

5.3 Coupling Elements

In some contexts a selectable protein that is present on a genetic construct serves as an adequate indicator of the expression of genes in other parts of the construct. For example expression of a colored protein from a construct that is stably maintained episomally, like a high copy plasmid in *E coli*, will provide a good indication of the average level of the construct in each cell, and of the expression of other parts of the construct within those cells.

In contrast, in other contexts different parts of a genetic construct may behave differently. For example transfection of a construct carrying a selectable marker and an unlinked expression cassette comprising a promoter, an open reading frame encoding a protein of interest and a polyadenylation signal into a mammalian cell results in random integration of parts of the construct over a period of several days. When the mammalian cells are placed under selective conditions (generally exposure to a drug), those cells that have stably integrated the selectable marker will survive, while those that have not will be killed. Integration of a construct into the genome of a mammalian cell is a random process, however. Not all of the construct will integrate, and not all of the constructs will integrate in the same place in the host genome. Thus the presence of the selectable protein indicates that an integration event has occurred, but it does not guarantee that the unlinked expression cassette has also integrated, nor does it provide a reliable indication of the expression levels of the protein of interest.

Tight linking of the expression of the selectable protein to the expression of the protein of interest can be achieved using coupling elements. Examples of coupling elements include internal ribosome entry sequences (IRES), 2A peptides and CHYSEL sequences. These sequences all allow the expression of more than one polypeptide to be driven by a single promoter sequence in eukaryotic cells. This in turn means that the expression level of the selectable protein is highly correlated with the expression level of the protein of interest. An IRES sequence provides two separate places where a ribosome may initiate translation on a single mRNA. An expression cassette using an IRES coupling element comprises a promoter, a nucleic acid sequence encoding a selectable protein, a nucleic acid sequence that forms an IRES and a nucleic acid sequence encoding an open reading frame of interest. One functional order of elements is promoter then selectable protein then IRES then open reading frame of interest. Another functional order of elements is promoter then open reading frame of interest then IRES then selectable protein. In some embodiments the selectable protein is a non-natural colored or fluorescent protein, in some embodiments the colored or fluorescent protein comprises 20, 21, 22, 23, 24, 25, 26, 27, 28, 29, 30, 31 32, 33, 34, 35, 36, 37, 38, 39, 40, 41, 42, 43, 44, 45, 46, 47, 48, 49, or 50 or more contiguous amino acids of any of SEQ ID NOS: 1-99, 161, 171, 175, 177, 179, 181, 183, 185, 187, 189, 213, 215, 217, 219 or 483-510. In some embodiments the IRES sequence is the EMCV IRES, in some embodiments the IRES sequence is SEQ ID NO: 459.

A 2A peptide sequence or a CHYSEL site causes a eukaryotic ribosome to release the growing polypeptide chain, but continue translating, thereby giving rise to two separate polypeptides from a single translating ribosome. An expression cassette using a 2A peptide or a CHYSEL coupling element comprises a promoter, a nucleic acid sequence encoding a selectable protein, a nucleic acid sequence that encodes a 2A peptide or a CHYSEL peptide and a nucleic acid sequence encoding an open reading frame of interest. One functional order of elements is promoter then selectable protein then 2A peptide or CHYSEL peptide then open reading frame of interest. Another functional order of elements is promoter then open reading frame of interest then 2A peptide or CHYSEL peptide then selectable protein. In some embodiments the selectable protein is a non-natural colored or fluorescent protein, in some embodiments the colored or fluorescent protein comprises 20, 21, 22, 23, 24, 25, 26, 27, 28, 29, 30, 31 32, 33, 34, 35, 36, 37, 38, 39, 40, 41, 42, 43, 44, 45, 46, 47, 48, 49, or 50 or more contiguous amino acids of any of SEQ ID NOS: 1-99, 161, 171, 175, 177, 179, 181, 183, 185, 187, 189, 213, 215, 217, 219 or 483-510. In some embodiments the 2A or CHYSEL peptide sequence is any of SEQ ID NOS: 100-159 or 481-482. In some embodiments the 2A or CHYSEL peptide sequence is encoded by any of the DNA sequences SEQ ID NOS: 457-458, 470-476, 480 or 511.

5.4 Applications

The presence of a genetic construct within a cell can be detected by including in the construct a gene encoding a selectable protein. Colored and fluorescent proteins, including all those listed in SEQ ID NOS: 1-99, 161, 171, 175, 177, 179, 181, 183, 185, 187, 189, 213, 215, 217, 219 and 483-510 are particularly advantageous classes of selectable proteins, as they provide a direct means of measuring the expression level of the gene that encodes them. Consensus sequences describing these proteins are disclosed as SEQ ID NOs:546-556. They can thus be used to quantitatively assess the functioning of other genetic elements with which they interact. For example, colored or fluorescent proteins can be used as reporters to measure the relative levels of transcriptional initiation achieved using different promoter elements. Colored or fluorescent proteins can be used as reporters to measure the relative levels of translational initiation achieved using different contexts around the initiation AUG, including ribosome binding sites in prokaryotes and "Kozak" consensus sequences in eukaryotes. Colored or fluorescent proteins can be used as reporters to measure the relative levels of an extrachromosomal genetic construct such as plasmids.

Colored or fluorescent proteins can also be used to quantitatively assess the impact of other factors upon the expression of a genetic construct. For example, the expression of a colored or fluorescent protein may serve as a reporter for the transcription from the location in the chromosome that a genetic construct integrates.

Fluorescent proteins can be used for a wide range of applications. They can be used in whole organisms, live cells as well as dying and dead cells, or preserved cells (e.g. paraformaldehyde). Fluorescent proteins may also be utilized in methods that do not require whole cells such as cell-free translation systems. Purified fluorescent proteins may retain activity and as such may also be used directly for products.

One method that involves the use of fluorescent proteins is transgene delivery. In experiments that involve delivery of a transgene through the use of an episomal DNA or a DNA that is integrated into the genome of a target organism, it is often useful to monitor the success rate of DNA delivery. Efficiency of DNA delivery can be monitored with fluorescent proteins expression driven by a promoter that is active in the recipient cell or organism.

Another example utilizing fluorescent proteins is to distinguish a transgenic animal among a group of non-transgenic animals. For example, transgenes inserted at the ROSA26 locus have been demonstrated to have ubiquitous spatial and temporal expression. As a result, mice generated with the transgene of interest, co-expressed with a fluorescent protein at ROSA26 can easily be visualized in a litter of mixed mice under UV light. An examination of accessible live tissues (eyes, snout, tip of tail) for signs of fluorescence allows quick identification of the presence of the transgene, bypassing the need for blood or tissue collection and performing PCR.

Similar to identification of whole animals through the use of fluorescent proteins, tissues in chimeric animals may also be detected through the use of fluorescent proteins. For example, many homozygous gene deletions in mice often lead to embryonic lethality and block the opportunity to study the consequences of gene deletion in adult tissues. A method to bypass embryonic lethality is the generation of mice that are chimeras, partly composed of cells carrying homozygous gene deletions and partly composed of wild type cells. For example, embryonic stem cells carrying a homozygous gene deletion may be injected into blastocysts isolated from wild type mice. The resultant adult mouse may have varying degrees of contribution from the stem cells with gene deletion that would be very difficult to distinguish, but may be clearly identified with the presence of a fluorescent protein marker. Another example where fluorescent proteins would be of use is experiments where healthy tissue was grafted onto models of disease or vice versa. In such instances tracking the tissue that was grafted would be possible with fluorescent protein.

Fluorescent proteins would also have utility in indicating the native cellular localization of a protein. Fluorescent proteins may be fused in-frame to proteins of interest via DNA that is expressed in target cells. Proteins of interest and fluorescent proteins may also be produced in vitro and cross-linked before delivery into cells of interest to determine protein localization. In the latter case the proteins may be delivered by any number of means such as protein transduction by hydrophobic peptides or electroporation. In either case another example of the utility of proteins seamlessly fused or chemically conjugated to a protein of interest is the ability to track the localization of a protein in response to stimuli. One example of this is the study of the changing localization of the p53 DNA binding protein in mammalian cells in response to the application of DNA damaging agents to cells in culture. For example, upon inducing DNA damage in cells, the p53-fluorescent protein hybrid would shuttle from the cytoplasm to the nucleus and could easily be monitored in live cells via microscopy.

The use of fluorescence resonance energy transfer (FRET) is another application for which fluorescent proteins may be utilized. In FRET two different proteins or protein fragments are fused to unique fluorescent proteins. The fluorescent proteins act cooperatively in that one fluorescent protein, upon being excited, has an emission that then excites the second protein which then produces the fluorescence that acts as the indicator for protein-protein interaction. In this way two proteins may be monitored for interaction. When the proteins of interest are not interacting, the fluorescence of one protein is observed. Once the proteins of interest are brought in close proximity, the fluorescence will be altered. The emission of one fluorescent protein fusion initiates fluorescence of a different wavelength from the second fluorescent protein fusion.

Specific examples of where FRET assays employing the subject fluorescent proteins may be used include, but are not limited to the detection of protein-protein interactions, e.g., mammalian two-hybrid system, transcription factor dimerization, membrane protein multimerization, multiprotein complex formation, etc., as a biosensor for a number of different events, where a peptide or protein covalently links a FRET fluorescent combination including the subject fluorescent proteins and the linking peptide or protein is, e.g., a protease specific substrate, e.g., for caspase mediated cleavage, a linker that undergoes conformational change upon receiving a signal which increases or decreases FRET, e.g., PKA regulatory domain (cAMP-sensor), phosphorylation, e.g., where there is a phosphorylation site in the linker or the linker has binding specificity to phosphorylated/dephosphorylated domain of another protein, or the linker has Ca2+ binding domain.

In another embodiment, the fluorescent proteins can be used in Luminescence Resonance Energy Transfer (LRET). LRET is a generalized version of Fluorescent Resonance Energy Transfer, or FRET, a widely used technique in polymer science, biochemistry and structural biology. LRET is particularly useful to obtain structural and kinetic information about macromolecules in solution, in real time. In one non-limiting example, double-end labeled oligonucleotides provide detectable LRET signaling when bound by nucleic acid binding proteins, e.g. transcription factors. Accordingly, the methods are used to screen for potential therapeutics that alter the structure or interactions of biomolecules; for example, anti-vital agents are screened for the ability to alter vital transcription factor-induced alterations in nucleic acid conformation.

In another embodiment, the fluorescent proteins can be used in Bioluminescence Resonance Energy Transfer (BRET). BRET refers the combination of a fluorescent protein and luciferase for resonance energy transfer. BRET refers to any method in which the luciferase is used to generate the light upon reaction with a luciferin which is then non-radiatively transferred to a fluorescent protein. The energy that is transferred from the luciferase to the fluorescent protein, shifts and produces an emission at a different wavelength. For example, a fluorescent protein can be directly fused to the a luciferase, which metabolizes coelenterazine in response to binding free calcium ions, thereby producing a sensor that reports calcium ion flux by increases in fluorescence.

In certain embodiments, FRET, LRET, and BRET can be used as a non-destructive, cell-based assay for proteomics applications. In specific embodiments, the proteomics application can be mapping of signal transduction pathways.

In certain embodiments, FRET, LRET, and BRET can be used to detect protein-protein interactions and receptor oligomerization. FRET, LRET, and BRET can also be used for GPCR functional assays and protease activity assays in living cells. FRET, LRET, and BRET can also be used for Ca2+ detection.

In certain embodiments, FRET, LRET, and BRET can be used to as a reporter system. For example, oligonucleotide backbones can be tagged with one or more chromo- or fluorophore wherein the tags act as resonance energy transfer (RET) probes. In one non-limiting example, FRET, LRET, and BRET can be used for real-time monitoring of biochemical reactions, in vivo studies, and in vitro studies. For example, DNA-based RET probes can be used to monitor various types of DNA and RNA reactions such as PCR, hybridization, ligation, cleavage, recombination, and synthesis. DNA-based RET probes can also be employed in sequencing, mutation detection, and as parts of biosensors to assess the concentrations of lead, DNA/RNA, and protein.

A further use of the fluorescent proteins of this invention involves their use as live reporters for cells that are undergoing or have undergone the processes of differentiation, trans-differentiation or dedifferentiation. This is accomplished by driving the expression of a fluorescent protein by a cell and/or tissue specific promoter. For example, stem cells that have been modified with DNA that encodes for GFP expression driven by a muscle specific promoter. The stem cells would be GFP negative when in an undifferentiated state or when differentiated into an irrelevant cell type. However, upon differentiating specifically into muscle cells, the cells would turn GFP positive and could then be identified by microscopy or cell sorting.

Fluorescent proteins of this invention may also act as indicators for protease activity or proteasome inhibition. For example, a fluorescent protein may be fused to a proteasome degradation signal and the resultant fusion protein will be degraded following translation. Upon addition of a proteasome inhibitor, or with protease cleavage of a linker connecting the fluorescent protein to the degradation signal, the fluorescent protein signal will be turned on and/or amplified as the levels of fluorescent protein build up in the cells.

Another example for which fluorescent proteins of this invention may be used is as indicators for in vitro translation reactions. For example, a control plasmid that produces GFP may be set up in parallel to a tube with an untagged protein of interest. The translation of GFP can easily be monitored with a handheld or box unit ultraviolet light, allowing for quick assessment of the success or failure of the control reaction. The fluorescent protein thus acts as a rapid indicator prior to involvement with a more elaborate assay such as a Western blot.

Another utility for fluorescent proteins of this invention involves monitoring cell lifespan and lineage analysis in vivo. For example, a stem cell modified with a fluorescent protein may be transplanted into an animal of interest. Once transferred to the recipient animal, periodic testing for the presence of fluorescence would be used to determine what progeny, if any, of a differing differentiation state were produced and the lifespan of the originally transferred stem cells.

In another example fluorescent proteins of this invention may act as indicators for exposure of cells to various stimuli. For example, bacterial cells may be modified such that the presence of mercury activates the expression of a fluorescent protein. Similarly in yeast, high exposure to salt may be measured by choosing a promoter known only to be upregulated in high salt conditions and using that promoter to drive the expression of a fluorescent protein.

Fluorescent proteins of this invention may also be incorporated into plants and animals for ornamental purposes. For example, colored proteins may be utilized for generating ornamental plants and, in a second example, fluorescent proteins may be used for generating transgenic animals that fluoresce when exposed to ultraviolet light. In a slightly different embodiment, the colored or fluorescent proteins may have their expression driven by promoters in the target organism that are not ubiquitous. For example, the proteins expression may be directed to certain body parts such as eyes. In yet a further variation, the colored or fluorescent proteins maybe driven by promoters serve as indicators of health for a plant or animal. For example, a promoter could be utilized that only drives the expression of a chromoprotein in a plant when that plant is under stress such as in conditions of dehydration.

A further use of fluorescent proteins of this invention is for monitoring expression in a multicistronic vector. For example, the fluorescent protein would be produced in parallel to the protein of interest either as a fusion protein with peptide cleavage sites or via a shared RNA or via a shared promoter as in the case of a small interfering RNA (siRNA). The presence of the fluorescent protein would indicate that any upstream RNA and or protein was efficiently produced in some amount less than, equal to or greater than the amount of fluorescent protein produced.

In certain embodiments, the fluorescent proteins can be used as biosensors in prokaryotic and eukaryotic cells. Non-limiting examples of biosensors include Ca2+ ion indicators, pH indicators, phorphorylation indicators, and indicators of other ions (e.g., magnesium, sodium, potassium, chloride and halides). For example, for detection of Ca2+ ion, proteins containing an EF-hand motif are known to translocate from the cytosol to membranes upon Ca2+ ion binding. These proteins contain a myristoyl group that is buried within the molecule by hydrophobic interactions with other regions of the protein. Binding of Ca2+ ion induces a conformational change exposing the myristoyl group which then is available for the insertion into the lipid bilayer (called a "$Ca^{2+}$-myristoyl switch"). Fusion of such an EF-hand containing protein to fluorescent protein could make it an indicator of intracellular Ca2+ ion by monitoring the translocation from the cytosol to the plasma membrane by confocal microscopy. EF-hand proteins suitable for use in this system include, but are not limited to: recoverin (1 3), calcineurin B, troponin C, visinin, neurocalcin, calmodulin, parvalbumin, and the like.

For pH indicators, a system based on hisactophilins may be employed for example. Hisactophilins are myristoylated histidine-rich proteins known to exist in Dictyostelium. Their binding to actin and acidic lipids is sharply pH-dependent within the range of cytoplasmic pH variations. In living cells membrane binding seems to override the interaction of hisactophilins with actin filaments. At pH 6.5 they locate to the plasma membrane and nucleus. In contrast, at pH 7.5 they evenly distribute throughout the cytoplasmic space. This change of distribution is reversible and is attributed to histidine clusters exposed in loops on the surface of the molecule. The reversion of intracellular distribution in the range of cytoplasmic pH variations is in accord with a pK of 6.5 of histidine residues. The cellular distribution is independent of myristoylation of the protein. By fusing a fluorescent protein to hisactophilin, the intracellular distribution of the fusion protein can be followed by laser scanning, confocal microscopy or standard fluorescence microscopy.

In certain embodiments, the fluorescent proteins can be used for quantitative fluorescence analysis. For example, quantitative fluorescence analysis can be done by performing line scans through cells (laser scanning confocal microscopy) or other electronic data analysis (e.g., using metamorph software (Universal Imaging Corp) and averaging of data collected in a population of cells. Substantial pH-dependent redistribution of hisactophilin-FP from the cytosol to the plasma membrane occurs within 1 2 min and reaches a steady state level after 5-10 min. The reverse reaction takes place on a similar time scale. As such, hisactophilin-fluorescent protein fusion protein that acts in an analogous fashion can be used to monitor cytosolic pH changes in real time in live mammalian cells.

Fluorescent proteins can also be used in high through-put applications. For example, fluorescent proteins can be used to measure pH changes as consequence of growth factor receptor activation (e.g. epithelial or platelet-derived growth factor). For example, fluorescent proteins can be used to measure chemotactic stimulation/cell locomotion. For example, fluorescent proteins can be used in the detection of intracellular pH changes as second messenger. For example, fluorescent proteins can be used to monitor intracellular pH in pH manipulating experiments.

Another example of a high through-put application is drug discovery. The fluorescent proteins, for example, can be proteins with half-lives of more than 24 h. The fluorescent proteins can also be destabilized versions of the 24-hr half-life fluorescent proteins with shorter half-lives that can be used as transcription reporters for drug discovery. For example, a fluorescent protein of this invention can be fused with a putative proteolytic signal sequence derived from a protein with shorter half-life. For a description of destabilized proteins and vectors that can be employed to produce the same, see e.g., U.S. Pat. No. 6,130,313; the disclosure of which is herein incorporated by reference. Promoters in signal transduction pathways can be detected using destabilized versions of these fluorescent proteins for drug screening, e.g., AP1, NFAT, NFkB, Smad, STAT, p53, E2F, Rb, myc, CRE, ER, GR and TRE, and the like.

The fluorescent proteins of this invention can also be used in automated screening of arrays. For example, cells can be engineered to express the fluorescent proteins which act as reporting groups and that can be detected by using microscopic imaging and electronic analysis. Screening can be used for drug discovery and in the field of functional genomics. For example, the fluorescent proteins can be used as markers of whole cells to detect changes in multicellular reorganization and migration. Multicellular reorganization and migration can be the formation of multicellular tubules (blood vessel formation) by endothelial cells, migration of cells through Fluoroblok Insert System (Becton Dickinson Co.), wound healing, and neurite outgrowth. The fluorescent proteins can be fused to peptides (e.g., targeting sequences) to act as a marker and can detect changes in intracellular location.

The fluorescent proteins can also be used to as indicators for cellular activity. Cellular activity can be, for example, signal transduction (such as kinase and transcription factor translocation upon stimuli, such as protein kinase C, protein kinase A, transcription factor NFkB, and NFAT), cell cycle proteins (such as cyclin A, cyclin B1 and cyclinE), and protease cleavage with subsequent movement of cleaved substrate, phospholipids, with markers for intracellular structures (such as endoplasmic reticulum, Golgi apparatus, mitochondria, peroxisomes, nucleus, nucleoli, plasma membrane, histones, endosomes, lysosomes, microtubules, and actin).

The fluorescent proteins can be used as tools for High Content Screening. High content screening can be, for example, co-localization of other fluorescent fusion proteins with these localization markers as indicators of movements of intracellular fluorescent fusion proteins/peptides or as marker alone; and the like. Examples of applications involving the automated screening of arrays of cells in which the subject fluorescent proteins find use include: U.S. Pat. No. 5,989,835; as well as WO/0017624; WO 00/26408; WO 00/17643; and WO 00/03246; the disclosures of which are herein incorporated by reference.

The fluorescent proteins can also be used as second messenger detectors, e.g., by fusing the subject proteins to specific domains: e.g., PKCgamma Ca binding domain, PKCgamma DAG binding domain, SH2 domain and SH3 domain, etc.

Secreted forms of these fluorescent proteins can be prepared, e.g. by fusing secreted leading sequences to the subject proteins to construct secreted forms of the subject proteins, which in turn can be used in a variety of different applications.

The fluorescent proteins of this invention can also be used in fluorescence activated cell sorting applications. In such applications, the subject fluorescent protein is used as a label to mark a population of cells and the resulting labeled population of cells is then sorted with a fluorescent activated cell sorting device, as is known in the art. FACS methods are described in U.S. Pat. Nos. 5,968,738 and 5,804,387; the disclosures of which are herein incorporated by reference.

The fluorescent proteins of this invention can also be used as in vivo markers in animals and plants (e.g., transgenic animals and transgenic plants). For example, expression of the fluorescent protein can be driven by tissue specific promoters. This method can be used, for example, for gene therapy (e.g., testing efficiency of transgenic expression).

The fluorescent proteins of this application can also be used as markers following injection into cells or animals and in calibration for quantitative measurements (fluorescence and protein); as markers or reporters in oxygen biosensor devices for monitoring cell viability; and as markers or labels for animals, pets, toys, food, etc.

The fluorescent proteins of this application can also be used in protease cleavage assays. For example, cleavage inactivated fluorescence assays can be developed using these fluorescent proteins, where the fluorescent proteins are engineered to include a protease specific cleavage sequence without destroying the fluorescent character of the protein. Upon cleavage of the fluorescent protein by an activated protease, fluorescence would sharply decrease due to the destruction of a functional chromophor. Alternatively, cleavage activated fluorescence can be developed using the fluorescent proteins, where the subject proteins are engineered to contain an additional spacer sequence in close proximity/or inside the chromophor. This variant would be significantly decreased in its fluorescent activity, because parts of the functional chromophor would be divided by the spacer. The spacer would be framed by two identical protease specific cleavage sites. Upon cleavage via the activated protease the spacer would be cut out and the two residual "subunits" of the fluorescent protein would be able to reassemble to generate a functional fluorescent protein. Both of the above described application could be developed in assays for a variety of different types of proteases.

The fluorescent proteins of this application can also be used is assays to determine the phospholipid composition in biological membranes. For example, fusion proteins of the fluorescent proteins (or any other kind of covalent or non-covalent modification of the subject proteins) that allows binding to specific phospholipids to localize/visualize patterns of phospholipid distribution in biological membranes also allowing colocalization of membrane proteins in specific phospholipid rafts can be accomplished with the subject proteins. For example, the PH domain of GRP1 has a high affinity to phosphatidyl-inositol tri-phosphate (PIP3) but not to PIP2. As such, a fusion protein between the PH domain of GRP1 and the subject proteins can be constructed to specifically label PIP3 rich areas in biological membranes.

The fluorescent proteins of this application can also be used as a fluorescent timer, in which the switch of one fluorescent color to another (e.g. green to red) concomitant with the ageing of the fluorescent protein is used to determine the activation/deactivation of gene expression, e.g., developmental gene expression, cell cycle dependent gene expression, and circadian rhythm specific gene expression.

The chromoproteins of this invention can be used in a variety of different applications. In one embodiment, the chromoproteins can be used as coloring agents that are capable of imparting color or pigment to a particular composition of matter. In a specific embodiment, the chromoproteins are non-toxic. Non-toxic chromoproteins can be incorporated into compositions such as foods, pharmaceuticals, cosmetics, living organisms, e.g., animals, and plants, for example. In specific embodiments, a sufficient amount of the chromoprotein is incorporated into the composition to impart the desired color or pigment thereto. The chromoprotein may be incorporated into the composition of matter using any convenient protocol, where the particular protocol employed will necessarily depend, at least in part, on the nature of the composition of matter to be colored. Non-limiting examples of protocols for incorporating the chromoproteins into compositions include dry blending, wet blending, diffusion, friction, spraying, injection, tattooing.

The chromoproteins can also be used as labels in analyte detection assays, e.g., assays for biological analytes of interest. In certain embodiments, the chromoproteins are incorporated into adducts with analyte specific antibodies or binding fragments thereof and subsequently used in immunoassays for analytes of interest in a complex sample. An another embodiment, the chromoproteins or chromogenic fragments thereof may be conjugated to ligands that specifically bind to an analyte of interest, or other moieties, growth factors, hormones, and the like; as is readily apparent to those of skill in the art.

In another embodiment, the chromoproteins may be used as selectable markers in recombinant DNA applications. For example, chromoproteins can be used in the production of transgenic cells and organisms. Accordingly, one can engineer a particular transgenic production protocol to employ expression of the chromoproteins as a selectable marker, either for a successful or unsuccessful protocol. In such an embodiment, the color of the subject chromoprotein in the phenotype of the transgenic organism produced by a particular process can be used to indicate that the particular organism successfully harbors the transgene of interest, often integrated in a manner that provides for expression of the transgene in the organism. When used a selectable marker, a nucleic acid encoding the chromoprotein can be employed in the transgenic generation process. Non-limiting examples of transgenic organisms include transgenic plants, animals, bacteria, fungi, yeast, and the like.

In another embodiment, the chromoproteins can be used in cosmetics, sunscreens, dyes, and pigments.

5.4.1 Artificial Cell Selection Through Flow Cytometry

Fluorescent proteins, including those listed as SEQ ID NOS: 1-99, 161, 171, 175, 177, 179, 181, 183, 185, 187, 189, 213, 215, 217, 219 or 483-510 can be used to distinguish between cells carrying two different genetic constructs if the constructs contain genes encoding different and differentiable fluorescent proteins. Fluorescent activated cell sorters are well known in the art as devices for separating cells based on different excitation and emission properties of fluorophores including fluorescent proteins Transient transfection of mammalian cells with episomal expression constructs is one of the most widely used technologies in cell biology and biochemistry. Over the past 20 years numerous methods have been developed to deliver plasmid DNAs into mammalian cells, include liposomal transfections, electroporations and ballistic DNA delivery. A recurring obstacle with all of these and other technologies meant to deliver DNAs en masse is that they are not highly efficient, or in the best case scenario are highly efficient for a limited number of immortalized cell lines. This often leads to experiments in which only a minority of cells produce the desired protein product and those cells are diluted by the non-transfected cells—ultimately leading to weaker signals on Western blots, lower yields from purification strategies, etc. As a result, methods have been developed to rapidly segregate cells expressing protein(s) of interest from cells which never received any DNA. The most common method for compensating for low efficiency transfections is the use of flow cytometry to isolate a desired cell population by levels of fluorescence.

For the purposes of sorting cells, ectopically expressed proteins are often tagged with a fluorescent protein such as green fluorescent protein (GFP). Or, the plasmid vector is modified to include a separate promoter which drives the expression of GFP or a cell surface receptor which can later be bound with a fluorescent antibody. By using a coupling element such as IRES or a CHYSEL sequence to link expression of a target protein with a fluorescent or chromogenic selectable protein, there will be no interference with the function of the target protein since its sequence need not be modified by the addition of a fluorescent tag. Further, by using a construct in which both proteins are expressed from the same mRNA ensures that expression of the two proteins is not uncoupled, for example by different responses of two different promoters.

5.4.2 Artificial Cell Selection Through Receptor-Substrate Interactions

In another embodiment of the invention, the selectable protein can be a protein that causes cells to adhere to substrates to which they do not normally adhere. For example the macrophage scavenger receptor causes mammalian cells to adhere bacteriological grade petri dishes. Most mammalian cell types will not adhere or adhere very poorly to petri dishes that have not been treated to render the surface hydrophilic and negatively charged. However, it is well known that macrophages will adhere to bacteriological grade petri dishes. This phenomenon is regularly utilized for isolation of bone-marrow macrophages from mixed populations of cells. Expression of macrophage scavenger receptor can cause other cell types to adhere to bacteriological grade petri dishes. There are other ways to produce adherent cells, by causing a cell to present on its surface any kind of bioadhesive or one half of a receptor-ligand pair, where the other half is present on the substrate. For example, a cell expressing surface displayed glutathione-S-transferase will bind to a substrate coated with glutathione, a cell expressing surface displayed antibody will bind to a substrate coated with the cognate antigen, a cell expressing surface displayed receptor will bind to a substrate coated with the cognate ligand. In addition, the macrophage scavenger receptor may itself be modified so that it adheres more strongly or less strongly than the wild type sequence to more easily select clones of a certain expression level. Additionally hSR1 could be made into a chimeric variant which response to the addition of a peptide, enzyme or small molecule drug to allow for more rapid detachment of cells from a substrate.

A coupling element such as IRES or a CHYSEL sequence can be used to link expression of a target protein to expression of a selectable protein comprising an adhesion protein such as a macrophage scavenger receptor.

An example protocol that exemplifies one embodiment of the invention is as follows. A cell line of interest that adheres poorly to a growth substrate (for example HeLa cells) can be transfected with a construct in which a target protein is linked through a coupling element to a selectable protein comprising the adhesion protein macrophage scavenger receptor. At a time post-transfection, when a media change would normally take place to decrease toxic effects of the transfection reagent, the cells are trypsinized and replated onto bacteriological petri dishes. Following an incubation period of between 8 and 96 hrs, the petri dish is washed several times so that non-adhering or weakly adhering cells are removed. Only the strongly adhering cells that are expressing the macrophage scavenger receptor, will remain bound to the substrate. Since the expression of the target protein is linked through a coupling element to expression of the macrophage scavenger receptor, those cells that remain most strongly bound are also those that are strongly expressing the target protein.

An adhesion protein such as the macrophage scavenger protein enables the rapid selection of transfected cells, whether the cells are normally adherent or in suspension, it would be useful in primary cells or immortalized and/or transformed cell lines, it will work in mammalian or other eukaryotic cells such as *drosophila* or other insect cells, and it is independent of the method by which DNA is delivered to the cell, including lipid reagent, ballistic DNA delivery, electroporation, ultrasound, nanocarrier or any other means of transgene delivery into a eukaryotic cell.

An adhesion protein such as the macrophage scavenger protein can also stabilize cells that become weakened, fragile or otherwise compromised in their ability to adhere to a surface. One example is the packaging of viral particles. Multiplasmid transfection and/or high protein production can lead to adherent packaging cell lines sloughing off of a plate. Added adhesion will reduce loss of cells during cases where routine media changes were necessary or one or more viral collections are involved. A second example is industrial protein production, the high levels of which can also impair the ability of adherent cells to remain firmly attached to a substrate.

An adhesion protein such as the macrophage scavenger protein can also convert a long term stable cell line to an ultra-adherent phenotype for routine enrichment of positive clones. Combined with transgenics vectors such as lentivirus, transposon or generic vectors (e.g. pcDNA3.1) used to establish long term, stable cell lines, adhesion proteins provide the opportunity to initially separate the expressing cells based on a characteristic other than drug resistance. Drug resistance is based on enzymatic activity of a drug resistance allele which may vastly differ in levels with the transgene of interest, yet still impart survival.

This method will allow a secondary selection for cells of interest following drug selection to initially select for cells maintaining the transgene. Direct linkage of a non-enzymatic hSR1 or like adhesion molecule will allow a secondary more stringent selection to occur for only cells truly expressing a transgene by a one-step passage through bacteriological petri dishes. This method will also allow routine follow up to purge cells in which expression was extinguished over a prolonged period of culture of a pool of stable clones or individually derived cell line. Again, this would only involve a simple one-step passage of the cell line on bacteriological petri dishes.

This method will allow cell culture of transgenic cell lines on a wider range of surfaces for biotechnological screening applications as allow a wider range of cell lines to be assayed in 2-D assays.

This method will facilitate the adhesion of transgenic mammalian cells to substrates that typically do not allow adhesion of mammalian cells. An example is the siliconized rubber polydimethylsiloxane (PDMS), often used in microfluidics and other high throughput screening technologies—PDMS must first be coated with a suitable extracellular matrix protein such as fibronectin in order for mammalian cell adhesion to take place. Fibronectin coating costs the investigator both from the price of the reagent and usually time as the coating treatment typically takes place overnight.

Suspension cells such as K562 leukemia cells have been well studied but similar to other suspension cell lines are not always suitable for 2D assays such as those that occur on the surface of a microchip array, etc. The invention would allow for immunological assays to be performed in a 2D environment whether that involves tissue culture grade plastic dishes, bacteriological grade dishes, PDMS or any other substrate to which a cell can be made to adhere with hSR1 or other receptor or bioadhesion molecule.

5.4.3 Stable Cell Lines Expressing Recombinant Proteins

The generation of stable cell lines expressing recombinant proteins, are essential for a wide range of applications, such as drug discovery assays, gene function studies and production of recombinant proteins. In contrast to transient expression, stable expression allows reproducible and long term expression of the gene of interest. Stable, long term expression of the desired recombinant protein can be achieved by eukaryotic vectors that either harbor elements for episomal maintenance in the nucleus of a transfected cell or via direct integration of the transfected plasmid into the genome of a target cell. Episomal stability is often limited, resulting in a gradual loss of transfected vectors.

Integration of the same DNA sequence encoding a protein of interest into different parts of the genome of a mammalian cell can result in very different levels of expression because of position effects. Linking the expression of the protein of interest to expression of a selectable protein, for example a non-natural colored or fluorescent protein, using an IRES or a 2A peptide or a CHYSEL peptide allows cells that are expressing high levels of the protein of interest to be identified by their high levels of expression of the colored or fluorescent protein.

Selection of a stable cell line based on expression of a drug resistance protein is often not a good indicator of the expression of a protein of interest, even if both proteins are encoded on the same transfected plasmid. When a plasmid integrates into a genome, the DNA is often fragmented as a part of the process, and not all of the plasmid may be integrated. Thus two sequences that are more distant from one another have a greater likelihood of being separated upon integration, with only one of the sequences surviving in a stable cell line. If the expression of a non-natural colored or fluorescent protein is driven by the same promoter as is driving expression of the protein of interest, which can be achieved using an IRES or a 2A peptide or a CHYSEL peptide, cells that are expressing high levels of the protein of interest will also be expressing high levels of the colored or fluorescent protein. In the case of 2A peptides or CHYSEL peptides, it will be particularly advantageous to have the colored or fluorescent protein translated after the protein of interest, since that will indicate that the promoter is functional and that an open reading frame upstream of the colored or fluorescent protein is being translated.

Another configuration of sequence elements that is advantageous for selection of stable cell lines expressing high levels of a protein of interest links the expression of the protein of interest to two selectable markers: one that is necessary for survival of the cell, and the other which provides a more quantitative measure of expression. Some embodiments of such a construct comprise a promoter, an open reading frame encoding a protein of interest linked using an IRES or a 2A peptide or a CHYSEL peptide to an open reading frame encoding a drug-resistance marker and an open reading frame encoding a non-natural colored or fluorescent protein. In some embodiments the open reading frames encoding the drug resistance marker and the non-natural colored or fluorescent protein are fused so that they encode a single polypeptide capable of performing both functions. In some embodiments the open reading frames encoding the drug resistance marker and the non-natural colored or fluorescent protein are linked using an IRES or a 2A peptide or a CHYSEL peptide.

In some embodiments, genomic integration is achieved using transposases or integrases. In some embodiments a transposase is encoded on the same plasmid as the sites recognized by the transposase for integration. In this case the portion of the plasmid coding for the transposase is looped out and degraded, thus allowing for the production of cell lines with stable integration of transgene(s). In some embodiments the transposase is the piggyBac transposase and uses the ability of transiently produced piggyBac transposase to efficiently integrate a defined region of plasmid vector into genomic TTAA sites. The piggyBac transposons have no limit to the size of DNA that they can integrate, also integration is reversible. Re-transfecting with a piggyBac transposase expression vector allows removal of the transposons from the genome, footprint-free.

In a transposase-directed integration, integration of a drug-resistance marker and an open reading frame of interest that are both carried within the transposon are highly linked. However integration is still essentially random and subject to position effects. Linking the expression of the protein of interest to expression of a selectable protein, for example a non-natural colored or fluorescent protein, using an IRES or a 2A peptide or a CHYSEL peptide allows cells that are expressing high levels of the protein of interest to be identified by their high levels of expression of the colored or fluorescent protein. Particularly beneficial transposon constructs comprise integration sites recognized by the transposase, a gene for expression of drug resistance in the host cell, a promoter that is active in the host cell, and an open reading frame encoding the protein of interest that is linked using an IRES or a 2A peptide or a CHYSEL peptide to an open reading frame encoding a colored or fluorescent protein. In some embodiments the promoter is the EF1 alpha or SV40 or MC1 or Ubb or Ubc or HSV TK or CMV promoter. In some embodiments the gene for expression of drug resistance results in resistance to puromycin or hygromycin or blasitcidin or zeocin or neomycin. In some embodiments the colored or fluorescent protein comprises 20, 21, 22, 23, 24, 25, 26, 27, 28, 29, 30, 31 32, 33, 34, 35, 36, 37, 38, 39, 40, 41, 42, 43, 44, 45, 46, 47, 48, 49, or 50 or more contiguous amino acids of any of SEQ ID NOS: 1-99, 161, 171, 175, 177, 179, 181, 183, 185, 187, 189, 213, 215, 217, 219 or 483-510. In some embodiments the IRES sequence is the EMCV IRES, in some embodiments the IRES sequence is SEQ ID NO: 459. In some embodiments the 2A or CHYSEL peptide sequence is any of SEQ ID NOS: 100-159 or 481-482. In some embodiments the 2A or CHYSEL peptide sequence is encoded by any of the DNA sequences SEQ ID NOS: 457-458, 470-476, 480 or 511.

In one embodiment mammalian promoter EF1-alpha, expression enhancement elements and the piggyBac transposase are in the same plasmid construct, allowing a simple one-step transfection without the need for co-transfection with two separate plasmids—one an expression plasmid and the other with the piggyBac transposase element, and ensures that a pool of antibiotic selected cells can be immediately used for functional assays. An IRES sequence (SEQ ID NO: 459) or sequence encoding a CHYSEL or 2A peptide (for example any of SEQ ID NOS: 100-159 or 481-482) can be used to create a bicistronic expression system that links expression of gene of interest to the expression of a selectable protein, selected from any of SEQ ID NOS: 1-99, 161, 171, 175, 177, 179, 181, 183, 185, 187, 189, 213, 215, 217, 219 or 483-510.

Stable, long term expression of the transgene can also be achieved using lentiviruses that can integrate their genetic material into the host cell. Lentiviruses (SEQ ID NOS: 463-467 and 477-479) can transduce both actively proliferating and non-replicating cells, which makes them very useful for studies in a variety of cell types including non-transformed cells. Lentiviral integration is also susceptible to position effects. As for transposon-based integration, linking the expression of the protein of interest to expression of a selectable protein, for example a non-natural colored or fluorescent protein, using an IRES or a 2A peptide or a CHYSEL peptide allows cells that are expressing high levels of the protein of interest to be identified by their high levels of expression of the colored or fluorescent protein.

Particularly beneficial lentiviral constructs (SEQ ID NOS: 463-467) comprise viral terminal repeats that direct integration, a gene for expression of drug resistance in the host cell, a promoter that is active in the host cell, and an open reading frame encoding the protein of interest that is linked using a 2A peptide or a CHYSEL peptide to an open reading frame encoding a colored or fluorescent protein. In some embodiments the promoter is the EF1 alpha or SV40 or MC1 or Ubb or Ubc or HSV TK or CMV promoter. In some embodiments the gene for expression of drug resistance results in resistance to puromycin or hygromycin or blasitcidin or zeocin or neomycin. In some embodiments the colored or fluorescent protein comprises 20, 21, 22, 23, 24, 25, 26, 27, 28, 29, 30, 31 32, 33, 34, 35, 36, 37, 38, 39, 40, 41, 42, 43, 44, 45, 46, 47, 48, 49, or 50 or more contiguous amino acids of any of SEQ ID NOS: 1-99, 161, 171, 175, 177, 179, 181, 183, 185, 187, 189, 213, 215, 217, 219 or 483-510. In some embodiments the 2A or CHYSEL peptide sequence is any of SEQ ID NOS: 100-159 or 481-482. In some embodiments the 2A or CHYSEL peptide sequence is encoded by any of the DNA sequences SEQ ID NOS: 457-458, 470-476, 480 or 511.

Inconsistencies in the levels of expression of DNA sequences encoding protein of interest ascribed to position effects may be reduced by using large flanking sequences, for example woodchuck hepatitis post-transcriptional regulatory element (WPRE) and scaffold attachment regions (SARs). A hypothesis for the mechanism is that SARs allow the transforming DNA to form its own chromatin domain, reducing influences of the chromatin structure of domains in the host genome into which it becomes incorporated. Viral cis-acting elements such as WPRE also enhance expression in various expression vector contexts regardless of the respective promoter. Integrating expression constructs further comprising post-transcriptional regulatory elements or scaffold attachment regions are advantageous embodiments of the invention.

Particularly beneficial lentiviral (SEQ ID NOS: 463-467) or piggyBac constructs (SEQ ID NOS: 460-462) comprise viral terminal repeats or piggyBac transposase respectively that direct integration, a gene for expression of drug resistance in the host cell as described herein, a promoter that is active in the host cell as described herein, and an open reading frame encoding the protein of interest that is linked using a 2A peptide or a CHYSEL peptide to an open reading frame encoding a colored or fluorescent protein and expression enhancement elements SAR and WPRE. In certain embodiments the expression vector sequence is any of SEQ ID NOS: 460-465.

Partial disintegration of integrating genetic constructs, and position effects upon expression are not unique to genomic integration in mammalian cells. Integration of the same DNA sequence encoding a protein of interest into different parts of the genome of a cell from any organism, for example *Pichia* (*K. pastoris*) or plant systems can result in very different levels of expression because of position effects and how the integration occurs. As described herein for mammalian cells, if the expression of a non-natural colored or fluorescent protein is driven by the same promoter as is driving expression of the protein of interest, which can be achieved using an IRES or a 2A peptide or a CHYSEL peptide, cells that are expressing high levels of the protein of interest will also be expressing high levels of the colored or fluorescent protein. For example, the chromo- and fluorescent proteins of this invention can be stably expressed in a cell line for use in applications described herein.

5.4.4 Additional Uses for the Recombinant Proteins

The recombinant proteins of this invention can also be used in assays wherein there is temporary conversion of a suspension cell line to a more readily transfectable cell line. For example, linking hSR1 or similar protein to a protein switch which normally degrades hSR1 except in the presence of an inhibitory peptide or drug would allow for the temporary conversion of a suspension cell line to an adherent cell line.

5.5 Design of Codon Variant Sets

Codon variants that affect the expression of a protein disclosed herein can be made using methods disclosed in U.S. Pat. No. 8,401,798 and U.S. patent application Ser. No. 13/720,597, both of which are incorporated by reference.

Specifically, Section 5 of U.S. Pat. No. 8,401,798 and U.S. patent application Ser. No. 13/720,597 is incorporated herein by reference.

Some embodiments comprise a plurality of expression cassettes. In some instances, this plurality of expression cassettes comprises two, three, four, or five or more expression cassettes. Each expression cassette comprises two polynucleotide sequence, nominally termed a first polynucleotide sequence and a second polynucleotide sequence.

The first or second polynucleotide of each expression cassette comprises a sequence encoding a polypeptide comprising a non-natural chromo- or fluorescent protein as described herein.

The sequence of each respective second polynucleotide in the plurality of expression cassettes encodes a respective single polypeptide sequence the entirety of which is at least ninety-five percent identical to the entirety of the respective single polypeptide sequence encoded by each other second polynucleotide in the plurality of expression cassettes.

The first polynucleotide in each expression cassette comprises a transcriptional initiation sequence. Each respective first polynucleotide sequence is identical to the first polynucleotide sequence in each other expression cassette in the plurality of expression cassettes.

The plurality of expression cassettes are introduced into a host cells, and the color or fluorescence of each host cell is used to assess the expression of the polypeptide. In certain embodiments, each expression cassette in the plurality of expression cassettes is introduced into a separate host cell. In certain embodiments the expression of the colored or fluorescent protein is used to identify host cells which are expressing preferred levels of the second protein.

In some embodiments, the host cell is a prokaryotic host. In certain embodiments the host cell is *E coli*. In some embodiments the host cell is a mammalian cell or a plant cell or an insect cell or a yeast cell.

Some embodiments comprise a plurality of five or more expression cassettes, with each expression cassette comprising a first polynucleotide sequence and a second polynucleotide sequence. Each respective second polynucleotide comprises a sequence encoding a polypeptide comprising a non-natural chromo- or fluorescent protein as described herein. The sequence of each respective second polynucleotide is identical to the second polynucleotide sequence of each other expression cassette in the plurality of expression cassettes. The first polynucleotide in each expression cassette comprises a sequence element that controls expression. Non-limiting examples of a sequence element that controls expression are a ribosome binding site, a promoter or a transcriptional terminator or a polyadenylation sequence, an mRNA destabilizing sequence, and an IRES sequence. Each respective first polynucleotide is different from any first polynucleotide sequence of any other expression cassette in the plurality of expression cassettes. The plurality of expression cassettes are introduced into host cells, and the color or fluorescence of each host cell is used to assess the expression of the polypeptide. In certain embodiments, each expression cassette in the plurality of expression cassettes is introduced into a separate host cell. Expression of the polypeptide is used to assess the activity of the respective sequence element that regulates expression. In some embodiments, the host cell is a prokaryotic host. In certain embodiments the host cell is *E coli*. In some embodiments the host cell is a mammalian cell or a plant cell or an insect cell or a yeast cell.

6. EXAMPLES

6.1 Expression of Secreted Cutinase Protein Expression Linked by a 2A Peptide to Expression of Cytoplasmic Non-Natural Color or Fluorescent Protein in Yeast *Komagataella pastoris*

Expression of a protein of interest can be assessed in a eukaryotic cell by monitoring the expression of a colored or fluorescent protein, for example by the visible color or fluorescence, where a single polynucleotide encodes the protein of interest, an in-frame cis-acting hydrolase element (CHYSEL) or a 2A peptide sequence and a colored or fluorescent protein all in the same open reading frame.

Expression constructs were constructed in which genes encoding colored or fluorescent markers were linked to a gene encoding a protein of interest (in this case a secreted 6×HIS-tagged cutinase) via different 2A peptide/CHYSEL sequences. The constructs comprised 81844 encoding cytoplasmic non-natural color protein yellow 1A (amino acid sequence SEQ ID NO: 161 encoded by DNA sequence SEQ ID NO: 160); 81845 encoding cytoplasmic color protein yellow 1B (amino acid SEQ ID NO: 163 encoded by DNA sequence SEQ ID NO: 162); 82269 encoding non-natural fluorescent protein mCherry (amino acid SEQ ID NO: 165 encoded by DNA sequence SEQ ID NO: 164) linked to secreted cutinase via a 2A element (SEQ ID NO 457) and an alpha factor secretion signal; 82270 encoding non-natural fluorescent protein mCherry (amino acid SEQ ID NO: 167 encoded by DNA sequence SEQ ID NO: 166) linked to secreted cutinase via EMCV 2A element (SEQ ID NO 476) and an alpha factor secretion signal; and 82271 encoding only the secreted cutinase (amino acid SEQ ID NO: 169 encoded by DNA sequence SEQ ID NO: 168) using the alpha factor secretion signal.

Constructs were linearized with restriction enzyme SacI (to increase the likelihood of integration into the AOX1 promoter site), and transformed by electroporation into competent *K. pastoris*. Following electroporation, samples were resuspended in 1 ml YPD with 0.5M Sorbitol and incubated at 30° C. with shaking for 1 hr. A portion of this was plated onto YPDS agar plates with increasing concentrations of Zeocin (200 to 1000 µg/ml) for the selection of multi-copy integrants. Plates were incubated at 30° C. for 3 days. Twelve transformants were picked for each of the constructs, grown in 300 ul BMD1% media containing 200 µg/ml zeocin. *K. pastoris* host strain was grown in media without zeocin as the negative control. Cultures were grown for 60 hrs at 28° C. with vigorous shaking, induced with BMM2 with 1% methanol for 12 hrs at 28° C. followed by addition of 50 µl BMM10 with 5% methanol twice a day for 60 hrs, for a total of 72 hrs. Induced cultures were centrifuged at 1500×g for 10 minutes at 4° C. to pellet cells. Yeast Busters reagent (Novagen) was used to lyse cell pellets for total cytoplasmic protein. Supernatants were concentrated 10 fold before loading onto gel. The twelve transformants picked for each of the gene constructs were ranked for color intensity (FIG. 1).

Clones showing the brightest color pellets were picked for gene constructs 81844 encoding cytoplasmic non-natural color protein yellow 1A (amino acid sequence SEQ ID NO: 161 encoded by DNA sequence SEQ ID NO: 160) and 81845 encoding cytoplasmic color protein yellow 1B (amino acid SEQ ID NO: 163 encoded by DNA sequence SEQ ID NO: 162) and run on gels as total cell lysates (FIG. 2). Colored protein bands (arrow) could clearly be seen in the total cell lysates compared to wild type *K. pastoris* negative control, showing expression of single colored protein.

Figure 3:
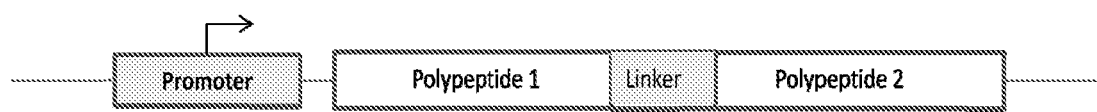

Expression of non-natural fluorescent proteins and secreted cutinase were measured when open reading frames encoding the two proteins were linked by a sequence encoding a 2A peptide element, as shown schematically in FIG. 3. Gene construct 82269 encoded non-natural fluorescent protein mCherry (amino acid SEQ ID NO: 165 encoded by DNA sequence SEQ ID NO: 164) linked to secreted cutinase via a TAV 2A peptide element (SEQ ID NO 457) and an alpha factor secretion signal; gene construct 82270 encoded non-natural fluorescent protein mCherry (amino acid SEQ ID NO: 167 encoded by DNA sequence SEQ ID NO: 166) linked to secreted cutinase via an EMCV 2A element (SEQ ID NO 476) and an alpha factor secretion signal. Gene construct 82271 encoded secreted cutinase alone (amino acid SEQ ID NOS: 169 encoded by DNA sequence SEQ ID NO: 168) and was used as a cutinase control.

Twelve colonies of *K. pastoris* transformed with each of the three constructs (82269-82271) were picked and induced for expression. Different colonies from 82269 and 82270, both of which contained mCherry linked by a 2A peptide to the secreted cutinase, were either noncolored, weakly colored or strongly colored, while no colonies from the control lacking the 2A peptide and the colored protein showed any color (FIG. 1). The intensity of the color in the yeast pellet was found to correlate with the amount of cutinase secreted into the medium, as detected by Western blotting (data not shown). Expression of a non-natural fluorescent protein could thus be used as a reliable and quick readout of expression level of a second protein linked via 2A peptide/CHYSEL elements in yeast.

6.2 Expression of Cytoplasmic Color Protein and Secreted Cutinase Expression Linked by Different 2A Elements Expression of a secreted protein of interest can be assessed in a eukaryotic cell by monitoring the expression of a colored or fluorescent protein, for example by the visible color or fluorescence, where a single polynucleotide encodes the protein of interest, an in-frame cis-acting hydrolase element (CHYSEL) or a 2A peptide sequence and a colored or fluorescent protein all in the same open reading frame. Colonies of cells with higher expression of the protein of interest can be identified by selecting colonies that produce the most color.

Gene constructs 82269 82270 and 82271 described in 6.1 above, were linearized using restriction enzyme SacI (to increase the likelihood of integration into the AOX1 promoter site), and transformed by electroporation into competent *K. pastoris*. Following electroporation, samples were resuspended in 1 ml YPD with 0.5M Sorbitol and incubated at 30° C. with shaking for 1 hr. A portion of this was plated onto YPDS agar plates with increasing concentrations of Zeocin (200 to 1000 μg/ml) for the selection of multi-copy integrants. Plates were incubated at 30° C. for 3 days. 48 transformants were picked for each of the constructs, grown in 300 ul BMD1% media containing 200 μg/ml zeocin. *K. pastoris* host strain was grown in media without zeocin as the negative control. Cultures were grown for 60 hrs at 28° C. with vigorous shaking, induced with BMM2 with 1% methanol for 12 hrs at 28° C. followed by addition of 50 μl BMM10 with 5% methanol twice a day for an additional 60 hrs, for a total of 72 hrs. Induced cultures were centrifuged at 1500×g for 10 minutes at 4° C. to pellet cells. Cell pellets for clones from gene constructs 82269 (SEQ ID NO: 165) and 82270 (SEQ ID NO: 167) were ranked for color intensity (FIG. 5). Two clones each of high, medium and low colored pellets were selected for gel analysis. Yeast Busters reagent from Novagen was used to lyse cell pellets for total cytoplasmic protein. Supernatants were concentrated 10 fold before loading onto gel.

Figure 4:
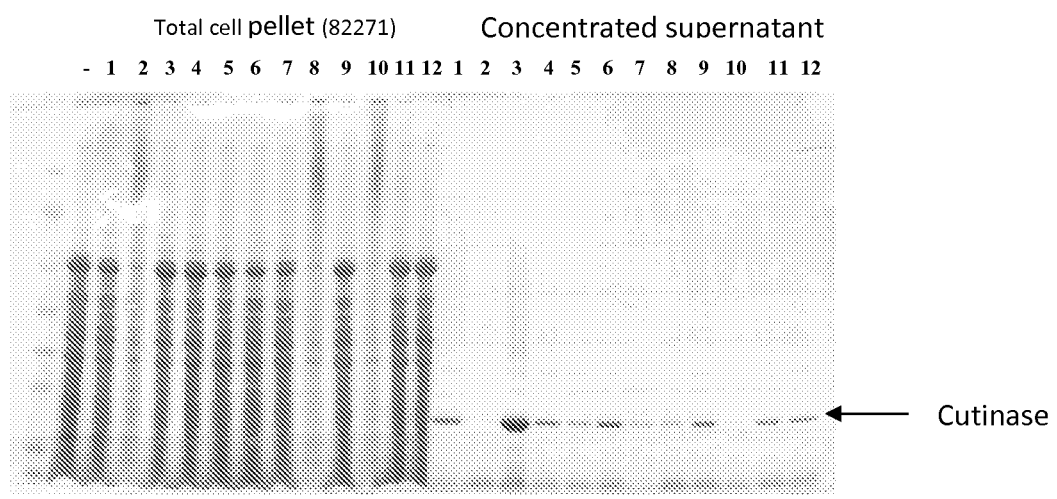

The expression of cutinase from 82271 is shown in FIG. 4. Secretion of cutinase in twelve randomly picked clones is shown in a coomassie gel. Although the ends of the construct contained homology to the AOX promoter, increasing the chance that the construct will integrate at this locus, there was still considerable variability in expression from one clone to another.

Figure 6:
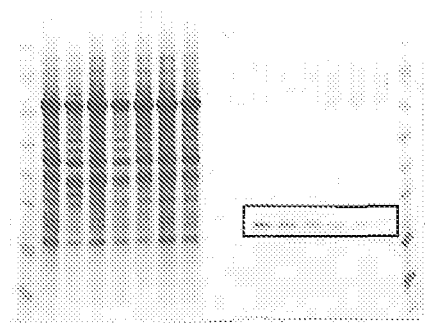
Figure 6:
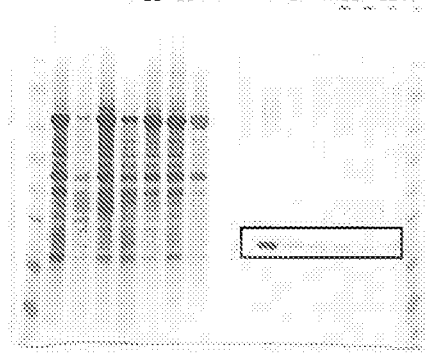
Figure 6:
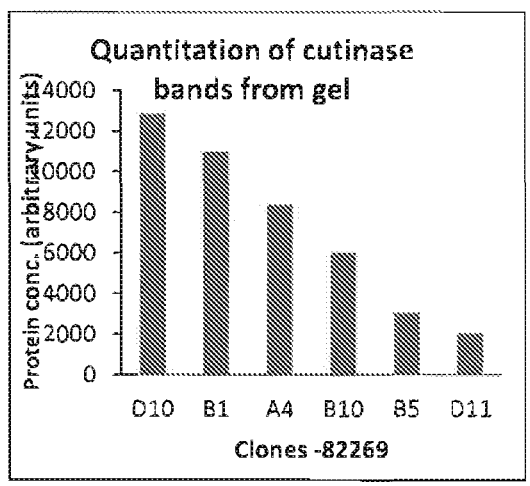
Figure 6:
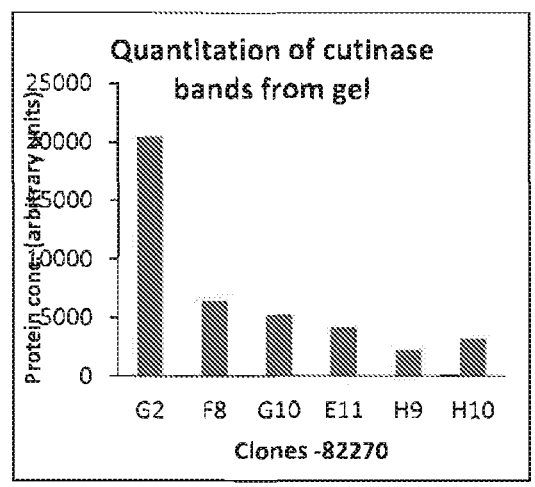

FIG. 5 shows a schematic representation of a culture plate into which 48 colonies transformed with construct 82269 and 47 colonies transformed with construct 82270 were picked. The numbers represent the color intensity seen after induction of the cells according to the protocol above. FIG. 6 shows a coomassie stained protein gel of the supernatants from 2 highly colored, 2 medium colored and 2 weakly colored cell pellets.

Clones D10 and B1 of *K. pastoris* transformed with gene construct 82269 had high expression of both the non-natural fluorescent protein mCherry (FIG. 5) and the secreted cutinase (FIG. 6). Medium color expressing clones A4 and B10, and low fluorescent protein expressing clones B5 and D11 had lower secreted cutinase expression. Similarly, the most highly colored pellet of *K. pastoris* transformed with gene construct 82270 (G2) were also the highest expressors of secreted cutinase (FIGS. 5 and 6). Intensity of the non-natural fluorescent protein correlated well with cutinase expression, and is therefore a powerful tool to quickly identify high expressing clones of the protein of interest in yeast.

6.3 Expression of Cytoplasmic Color Proteins in *K. Pastoris*

Color Reflects Expression Level

Expression of a protein of interest which comprises a colored or fluorescent protein can be assessed in a eukaryotic cell by monitoring the visible color or fluorescence. Colonies of cells with higher expression of the protein of interest can be identified by selecting colonies that produce the most color.

A selection of cytoplasmic colored protein constructs that encode a variety of non-natural color proteins were expressed in the yeast *K pastoris*. Construct 86197 encoded non-natural color protein violet 1 (amino acid SEQ ID NO: 171 encoded by DNA sequence SEQ ID NO: 170), 86198 encoded non-natural color protein magenta (amino acid SEQ ID NO: 173 encoded by DNA sequence SEQ ID NO: 172), 86199 encoded non-natural color protein pink orange (amino acid SEQ ID NO: 175 encoded by DNA sequence SEQ ID NO: 174), 86200 encoding non-natural color protein pink 1 (amino acid SEQ ID NO: 177 encoded by DNA sequence SEQ ID NO: 176), 86201 encoding non-natural color protein pink 2 (amino acid SEQ ID NO: 179 encoded by DNA sequence SEQ ID NO: 178), 86202 encoding non-natural color protein purple 1 (amino acid SEQ ID NO: 181 encoded by DNA sequence SEQ ID NO: 180), 86203 encoding non-natural color protein purple 2 (amino acid SEQ ID NO: 183 encoded by DNA sequence SEQ ID NO: 182) were linearized, transformed, cultured, induced for 60 hrs and prepared for gel analysis as per example 6.2 (above).

Twelve colonies of *K. pastoris* transformed with each constructs were picked for induction. Color production was seen in all constructs with variability in color intensity and expression level. All of the colors were easily visible in culture except for gene construct 86200 encoding non-natural color protein pink 1 (SEQ ID NO: 177) which was pale. *K. pastoris* transformed with gene constructs 86197, 86198 and 86201, showed variability in color expression. *K. pastoris* transformed with gene constructs 86199, 86202 and 86203 showed strong color intensity though with some variability in expression levels.

Figure 7:
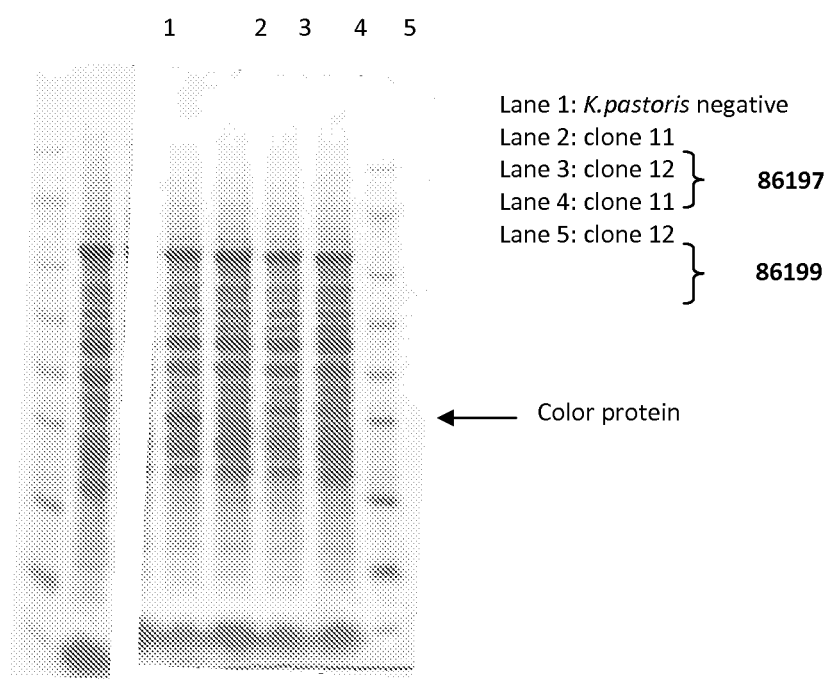

One strong and one weak color producing clones of *K. pastoris* transformed with construct 86197 and two strong color producing clones of *K. pastoris* transformed with 86199 were prepared for gel analysis (FIG. 7). Clone 11 of *K. pastoris* transformed with gene construct 86197 encoding non-natural color protein violet 1 (SEQ ID NO: 171) showed strong color intensity correlating with a highly expressed protein band detectable by coomassie staining of a protein gel (FIG. 7), clone 12 showed less intense color which corresponded to a much less well expressed band on gel (FIG. 7). Clones 11 and 12 of *K. pastoris* transformed with gene construct 86199 encoding non-natural color protein pink orange (SEQ ID NO: 175) showed similar color intensities and corresponded to bands of similar intensity on a polyacrylamide gel (FIG. 7). Thus the color of cells expressing colored proteins is a good indicator of the expression levels of those proteins in those cells.

6.4 Expression of Non-Natural Color Protein is Affected by Integration Site in *K. pastoris*

Expression from a genomically integrated genetic construct can be assessed in a eukaryotic cell by monitoring the expression of a colored or fluorescent protein, for example by visible color or fluorescence, where the genetic construct comprises a nucleotide sequence encoding a colored or fluorescent protein. Colonies of cells with higher expression of the protein of interest can be identified by selecting colonies that produce the most color. This allows identification of constructs that have integrated into parts of the host genome that are most favorable for expression.

Gene constructs 86198 and 86202 described in 6.3 above, were linearized with SwaI or SacI restriction enzymes, transformed into *K. pastoris* (ATCC 76273) and plated onto YPDS+200 µg/ml zeocin. 24 clones from each construct/restriction digest were picked and grown for 60 hrs for biomass production in the presence of 200 µg/ml zeocin, and induced with methanol for 48 hrs. The plate with induced cultures was centrifuged to pellet the cells. Plasmids linearized with SacI showed a higher frequency of strong color production than plasmids linearized with SwaI. SacI restriction site targets integration to favor the AOX1 promoter site in the chromosomal DNA, while SwaI does not target the integration site into the chromosome. Although linearization with SacI increases the chance of integration into the AOX1 promoter site and positively affects cytoplasmic color production in *K. pastoris*, expression of proteins is sensitive to positional effects of integration in *K. pastoris* even when integration is "targeted".

6.5 Expression of Non-Natural Red Color Protein in Yeast

Gene construct 87658 encoded non-natural red color protein (amino acid SEQ ID NO: 185 encoded by DNA sequence SEQ ID NO: 184); 87659 encoded non-natural red color protein (amino acid SEQ ID NO: 187 encoded by DNA sequence SEQ ID NO: 186); and 87660 encoded non-natural red color protein (amino acid SEQ ID NO: 189 encoded by DNA sequence SEQ ID NO: 188). The constructs were linearized with SacI, transformed into *K. pastoris*, clones grown in YPDS+200 µg/ml and induced with methanol for 48 hrs at 28° C. Plate with induced cultures was centrifuged to pellet cells. Good color expression was observed for *K. pastoris* transformed with constructs 87658 and 87660; color expression in of *K. pastoris* transformed with construct 87659 was weak. Expression was again seen to be variable, demonstrating the need for a reliable indicator of expression from expression constructs integrated into the genome of yeast.

6.6 Expression of Non-Natural Color Proteins Linked by a 2A Peptide Sequence to Cutinase Expression Expression of a protein of interest can be assessed in a eukaryotic cell by monitoring the expression of a colored or fluorescent protein, for example by the visible color or fluorescence, where a single polynucleotide encodes the protein of interest, an in-frame cis-acting hydrolase element (CHYSEL) or a 2A peptide sequence and a colored or fluorescent protein all in the same open reading frame. Colonies of cells with higher expression of the protein of interest can be identified by selecting colonies that produce the most color.

Gene construct 94022 comprised DNA SEQ ID NO: 190, encoding amino acid SEQ ID NO 191, encoding non-natural color protein (amino acid SEQ ID NO: 172 encoded by DNA sequence SEQ ID NO: 171) linked by a 2A peptide (amino acid SEQ ID NO: 481 encoded by DNA sequence SEQ ID NO: 480) to secreted cutinase (amino acid SEQ ID NO: 167 encoded by DNA sequence SEQ ID NO: 166) with 6×His tag; construct 94024 comprised DNA SEQ ID NO: 192, encoding amino acid SEQ ID NO 193, encoding non-natural color protein (amino acid SEQ ID NO: 172 encoded by DNA sequence SEQ ID NO: 171) (amino acid SEQ ID NO: 193 encoded by DNA sequence SEQ ID NO: 192) linked by a 2A peptide (amino acid SEQ ID NO: 481 encoded by DNA sequence SEQ ID NO: 480) to cytoplasmic cutinase (amino acid SEQ ID NO: 167 encoded by DNA sequence SEQ ID NO: 166) with 6×His tag. The two constructs were linearized with SacI restriction enzyme, transformed into *K. pastoris*, growth and induction conditions were same as described for example 6.2. Induced cultures were centrifuged to pellet cells. Cultures were ranked based on color intensity as low (L), medium (M), high (H) and very high color (VH) (FIG. 8).

Figure 9:
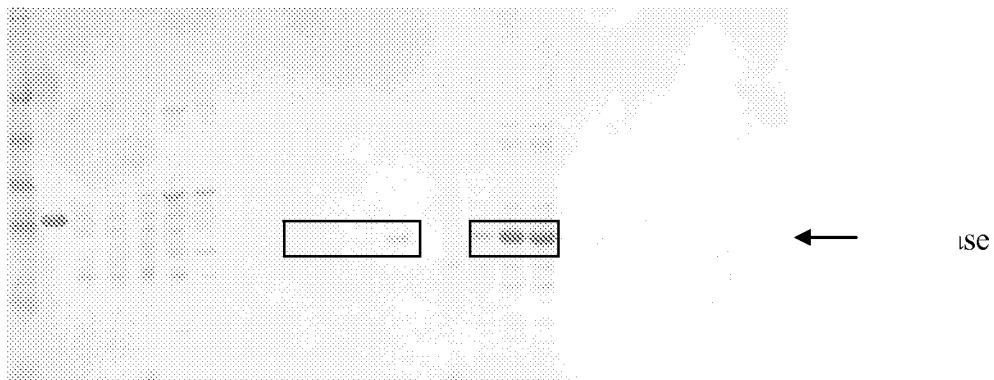
Figure 9:
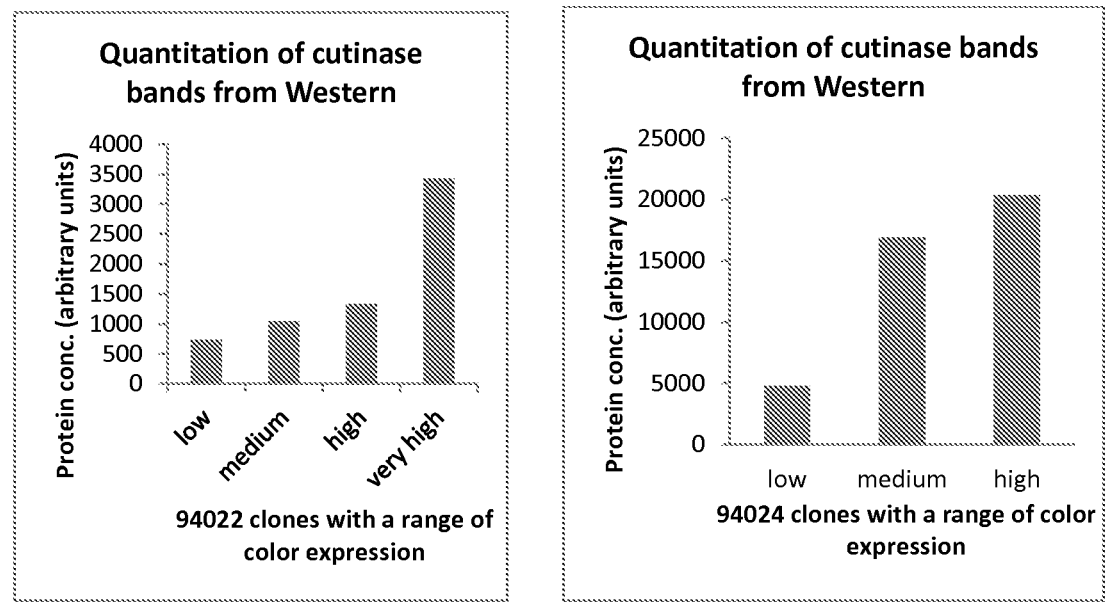

One representative culture from each of the color intensities were picked for each of the constructs and samples prepared for gel analysis. Western blots were used to detect secreted 6×His-tagged cutinase from cells transformed with construct 94022, or in the cytoplasmic lysate from cells transformed with construct 94024. The color of the cell pellets correlated well with the relative level of cutinase expression (FIG. 9). Thus expression of a colored protein linked by a 2A peptide or CHYSEL sequence to a protein of interest can be used to identify transformants that are expressing high levels of the protein of interest. Although the colored protein is cytoplasmic in both constructs, it can serve as an indicator for proteins that are themselves either secreted or cytoplasmic.

6.7 Expression of Non-Natural Color Proteins Linked to Vaccinia Polymerase Expression Expression of a protein of interest can be assessed in a yeast cell by monitoring the expression of a colored or fluorescent protein, for example by the visible color or fluorescence. A single polynucleotide encodes the protein of interest, an in-frame cis-acting hydrolase element (CHYSEL) or a 2A peptide sequence and a colored or fluorescent protein all in the same open reading frame. Colonies of cells with higher expression of the protein of interest can be identified by selecting colonies that produce the most color.

Gene construct 87858 (comprising amino acid SEQ ID NO: 195 encoded by DNA sequence SEQ ID NO: 194) encoded non-natural color protein magenta (amino acid SEQ ID NO: 173 encoded by DNA sequence SEQ ID NO: 172) linked by a 2A peptide (amino acid SEQ ID NO: 481 encoded by DNA sequence SEQ ID NO: 480) to 6×HIS-tagged vaccinia polymerase; gene construct 87859 (comprising amino acid SEQ ID NO: 197 encoded by DNA sequence SEQ ID NO: 196) encoded non-natural color protein pink-orange (amino acid SEQ ID NO: 175 encoded by DNA sequence SEQ ID NO: 174) linked by a 2A peptide (amino acid SEQ ID NO: 481 encoded by DNA sequence SEQ ID NO: 480) to 6×HIS-tagged vaccinia polymerase; gene construct 87860 (comprising amino acid SEQ ID NO: 199 encoded by DNA sequence SEQ ID NO: 198) encoded non-natural color protein purple (amino acid SEQ ID NO: 181 encoded by DNA sequence SEQ ID NO: 180) linked by a 2A peptide (amino acid SEQ ID NO: 481 encoded by DNA sequence SEQ ID NO: 480) to 6×HIS-tagged vaccinia polymerase. These constructs were linearized with SacI restriction enzyme, transformed into K. pastoris, grown and induced as described in example 6.2. Induced cultures were centrifuged to pellet cells. Cultures were ranked based on color intensity as low (L), medium (M) and high color (H) (FIG. 10). Uninduced K. pastoris was run as a negative control.

Figure 11:
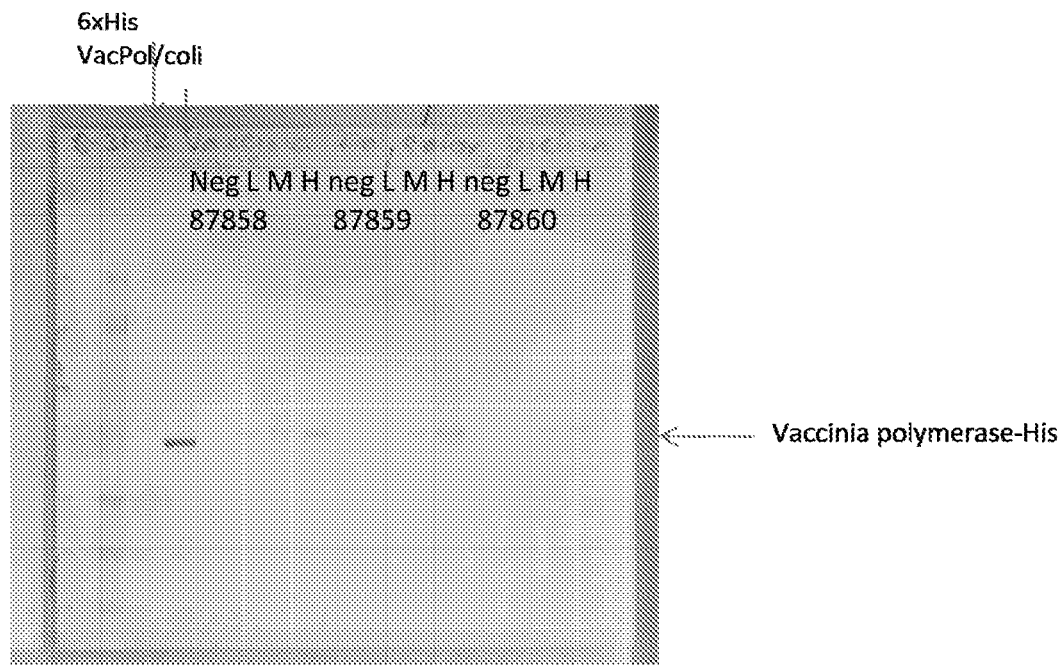
Figure 11:
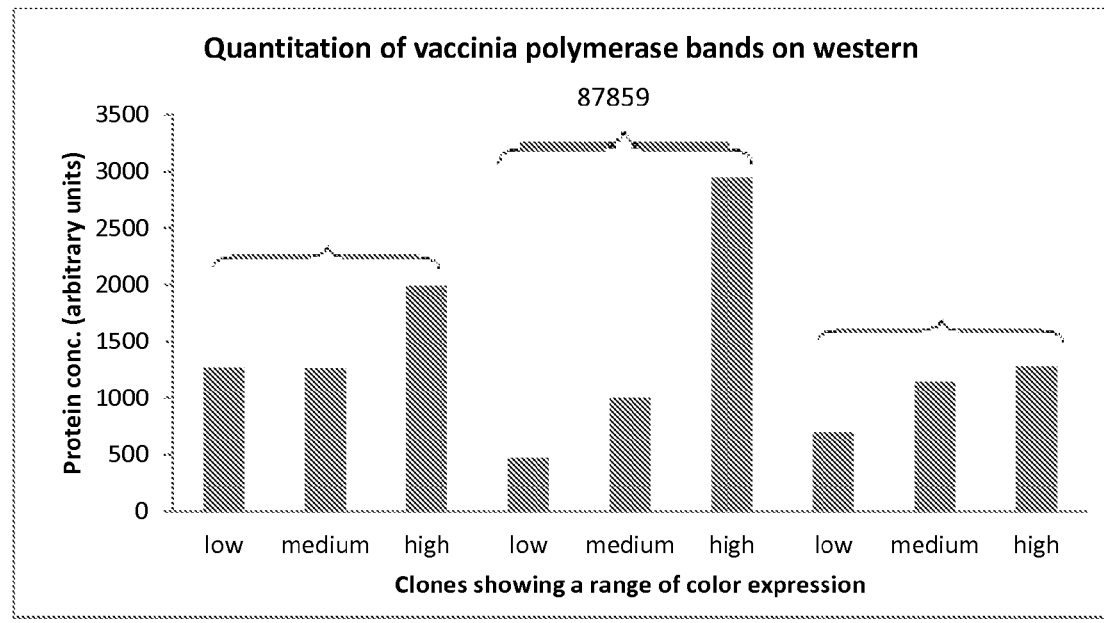

One representative culture from each of the color intensities was picked for each of the constructs and samples prepared for gel analysis, to run as total cytoplasmic lysates, as coomasie stained gels (FIG. 11, left panel) and Western blot to detect 6×His tagged polymerase (FIG. 11, right panel).

Expression of cytoplasmic vaccinia polymerase was higher from colonies with greater color intensities for K. pastoris transformed with constructs 87858 and 87859. K. pastoris transformed with construct 87860 yielded lower levels of polymerase, corresponding to overall lower color intensity observed. Using color intensity of non-natural color proteins as a measure of polymerase expression, we were able to quickly identify clones with higher polymerase expression. Thus expression of a colored protein linked by a 2A peptide or CHYSEL sequence to a protein of interest can be used to identify transformants that are expressing high levels of the protein of interest.

6.8 Expression of Non-Natural Pink Color Proteins Linked by TAV 2A or EMCV 2A Peptides to Cutinase Expression Expression of a protein of interest can be assessed in a yeast cell by monitoring visible color or fluorescence if a single polynucleotide encodes the protein of interest, an in-frame cis-acting hydrolase element (CHYSEL) or a 2A peptide sequence and a colored or fluorescent protein all in the same open reading frame. Colonies of cells with higher expression of the protein of interest can be identified by selecting colonies that produce the most color.

Gene construct 84674 (comprising amino acid SEQ ID NO: 201 encoded by DNA sequence SEQ ID NO: 200) encoded non-natural pink 2 color protein (amino acid SEQ ID NO: 179 encoded by DNA sequence SEQ ID NO: 178) linked by the TAV 2A peptide (amino acid SEQ ID NO: 481 encoded by DNA sequence SEQ ID NO: 480) to a 6×HIS-tagged secreted cutinase; construct 84675 (comprising amino acid SEQ ID NO: 203 encoded by DNA sequence SEQ ID NO: 202) encoded non-natural pink 2 color protein (amino acid SEQ ID NO: 179 encoded by DNA sequence SEQ ID NO: 178) linked by the EMCV 2A peptide (amino acid SEQ ID NO: 482 encoded by DNA sequence SEQ ID NO: 476) to a 6×HIS-tagged secreted cutinase. The constructs were linearized with SacI restriction enzyme, transformed into K. pastoris, grown and induced as described in example 6.2. Induced cultures were centrifuged to pellet cells. Cultures were ranked based on color intensity as low (L), medium (M) and high color (H) (FIG. 12). Uninduced K. pastoris was run as a negative control.

Figure 13:
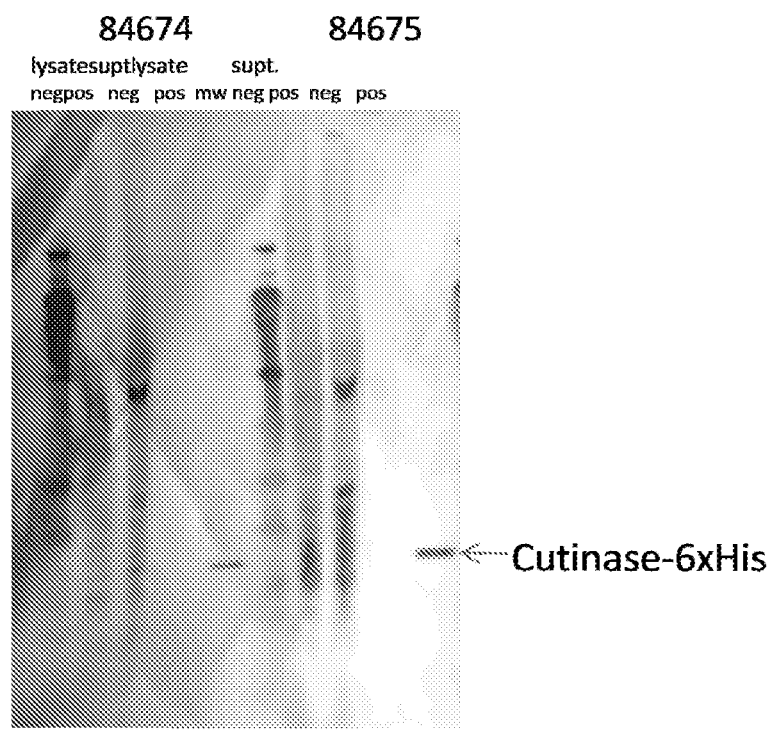

In these experiments the overall intensity of color was low. None of the cultures showed pink color expression of medium intensity for construct 84674 and only 4% showed medium intensity color expression in construct 84675 (shown in FIG. 12). One culture with the highest color level (pos) of K. pastoris transformed with each of the constructs was selected together with a second culture in which no color expression was observed (neg). Samples were prepared for gel analysis, to run as total cytoplasmic lysates as well as concentrated supernatant (FIG. 13). Western blot was run to detect 6×His tagged cutinase (FIG. 13).

As observed from FIGS. 12 and 13, expression of secreted cutinase increased with higher color intensities for constructs 84674 and 84675. Although color intensities with pink 2 color were lower, cutinase expression was still linked to color intensity. Thus expression of a colored protein linked by a 2A peptide or CHYSEL sequence to a protein of interest can be used to identify transformants that are expressing high levels of the protein of interest.

6.9 Expression of Non-Natural Purple Color Proteins Linked by 2A Peptides to Secreted Cutinase Expression Expression of a protein of interest can be assessed in a Pichia (K. pastoris) culture by monitoring the expression of a colored protein by visible color. A single polynucleotide encodes the protein of interest, an in-frame cis-acting hydrolase element (CHYSEL) or a 2A peptide sequence and a colored protein all in the same open reading frame. Cultures of cells with higher expression of the protein of interest can be identified by selecting colonies that produce the most color.

Gene construct 84676 (comprising amino acid SEQ ID NO: 205 encoded by DNA sequence SEQ ID NO: 204) encoded non-natural purple color protein (amino acid SEQ ID NO: 181 encoded by DNA sequence SEQ ID NO: 180) linked by the TAV 2A peptide (amino acid SEQ ID NO: 481 encoded by DNA sequence SEQ ID NO: 480) to a 6×HIS-tagged secreted cutinase; construct 84677 (comprising amino acid SEQ ID NO: 207 encoded by DNA sequence SEQ ID NO: 206) encoded non-natural purple color protein (amino acid SEQ ID NO: 181 encoded by DNA sequence SEQ ID NO: 180) linked by the EMCV 2A peptide (amino acid SEQ ID NO: 482 encoded by DNA sequence SEQ ID NO: 476) to a 6×HIS-tagged secreted cutinase. The constructs were linearized with SacI restriction enzyme, transformed into K. pastoris, grown and induced as described in example 6.2. Induced cultures were centrifuged to pellet cells. Cultures were ranked based on color intensity as low (L), medium (M) and high color (H) (FIG. 14). Uninduced K. pastoris was run as a negative control.

Figure 15:
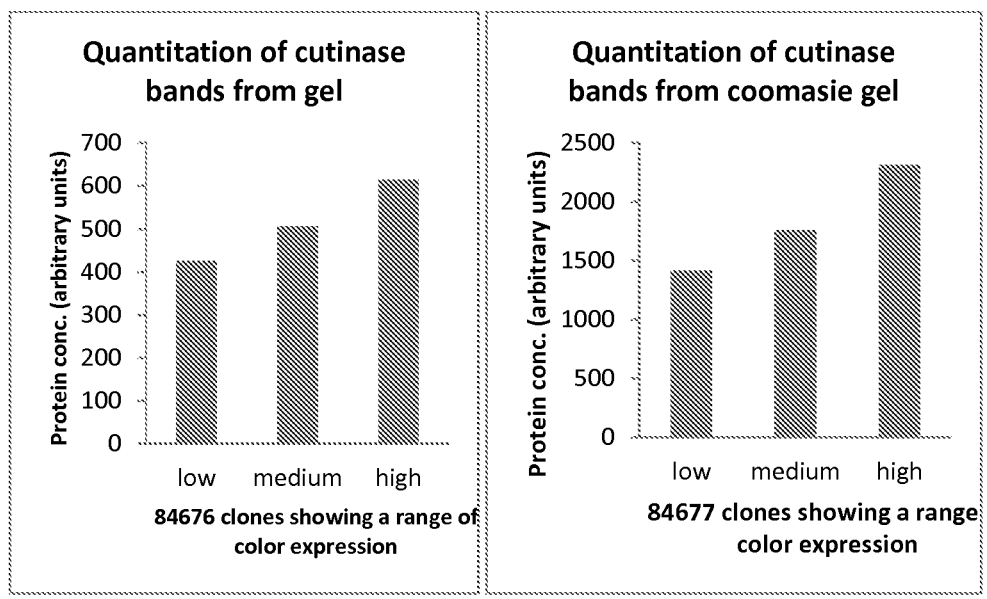

FIG. 15 shows that expression of secreted cutinase increased with higher color intensities for K. pastoris transformed with constructs 84676 and 84677. Thus expression of a colored protein linked by a 2A peptide or CHYSEL sequence can be used to identify transformants that are expressing high levels of a protein of interest.

6.10 Expression of Green Fluorescent Protein Linked Through a 2A Peptide to Secreted Cutinase Expression Expression of a protein of interest can be assessed in a *Pichia* (*K. pastoris*) culture by monitoring the expression of a fluorescent protein by visible fluorescence. A single polynucleotide encodes the protein of interest, an in-frame cis-acting hydrolase element (CHYSEL) or a 2A peptide sequence and a fluorescent protein all in the same open reading frame. Cultures of cells with higher expression of the protein of interest can be identified by selecting colonies that produce the most fluorescence.

Gene construct 84681 (comprising amino acid SEQ ID NO: 211 encoded by DNA sequence SEQ ID NO: 210) encoding non-natural color protein green (amino acid SEQ ID NO:27) linked by the EMCV 2A peptide (amino acid SEQ ID NO: 482 encoded by DNA sequence SEQ ID NO: 476) to a 6×HIS-tagged secreted cutinase. The construct was linearized with SacI restriction enzyme, transformed into *K. pastoris*, grown and induced as described in example 6.2. Induced cultures were centrifuged to pellet cells. Cultures were ranked based on color intensity as low (L), medium (M) and high color (H) (FIG. 16). Uninduced *K. pastoris* was run as a negative control.

Figure 17:
Figure 17:
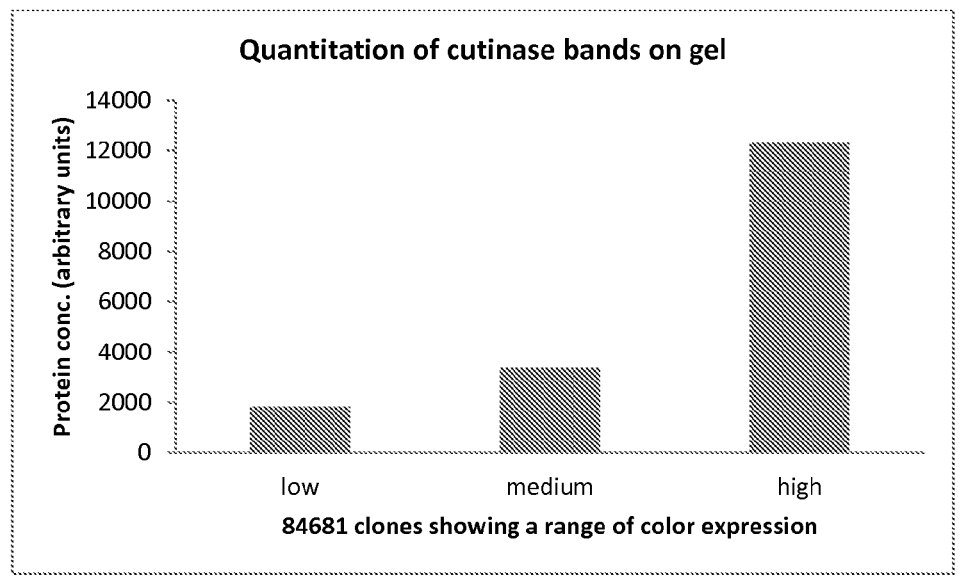

One representative culture from each of the low, medium and high color intensity cultures was picked samples prepared for gel analysis, to run as total cytoplasmic lysates as well as concentrated supernatant (FIG. 17).

As observed from FIGS. 16 and 17, expression of secreted cutinase increases with higher fluorescence intensities for *K. pastoris* transformed with construct 84681. The level of cutinase expression is directly related to expression and intensity of non-natural color protein. Thus expression of a fluorescent protein linked by a 2A peptide or CHYSEL sequence can be used to identify transformants that are expressing high levels of a protein of interest.

6.11 Expression of Non-Natural Red Color Protein in Constructs 95814, 95815, 95816 and 95817

Gene constructs 95814 encoding non-natural red 6 color protein (amino acid SEQ ID NO: 213 encoded by DNA sequence SEQ ID NO: 212), 95815 encoding non-natural red 3 color protein (amino acid SEQ ID NO: 215 encoded by DNA sequence SEQ ID NO: 214), 95816 encoding non-natural red 4 color protein (amino acid SEQ ID NO: 217 encoded by DNA sequence SEQ ID NO: 216) and 95817 encoding non-natural red 5 color protein (amino acid SEQ ID NO: 219 encoded by DNA sequence SEQ ID NO: 218), were linearized with SacI restriction enzyme, transformed into *K. pastoris*, grown and induced as described for example 6.2. Sixteen clones were picked for induction. Induced cultures were centrifuged to pellet cells. Uninduced *K. pastoris* was run as a negative control. Cultures were ranked based on color intensity as low (L), medium (M) and high color (H) (FIG. 18).

*K. pastoris* transformed with constructs 95815 and 95817 showed the highest number of clones of high color intensity, 81% and 12.5% respectively, and 19% and 75% of medium color intensity (FIG. 18). All colonies of *K. pastoris* transformed with tested for constructs 95815 and 95817 showed color expression. For *K. pastoris* transformed with construct 95816 a majority of clones tested showed low or medium color expression, 31% and 56% respectively, 6% of clones showed high color intensity and 6% showed no color. Colonies of *K. pastoris* transformed with construct 95815 showed no color expression. Overall, constructs 95815 and 95817 showed the best red color expression in *K. pastoris*.

6.12 Expression of Non-Natural Color Protein Linked by a 2A Peptide to Cutinase Expression Gene construct 95951 comprised amino acid SEQ ID NO: 221 encoded by DNA sequence SEQ ID NO: 220, encoding non-natural color protein magenta (amino acid SEQ ID NO: 173 encoded by DNA sequence SEQ ID NO: 172) linked by the TAV 2A peptide (amino acid SEQ ID NO: 481 encoded by DNA sequence SEQ ID NO: 480) to a 6×HIS-tagged secreted cutinase; construct 95952 (comprising amino acid SEQ ID NO: 223 encoded by DNA sequence SEQ ID NO: 223) encoded non-natural color protein magenta (amino acid SEQ ID NO: 173 encoded by DNA sequence SEQ ID NO: 172) linked by the TAV 2A peptide (amino acid SEQ ID NO: 481 encoded by DNA sequence SEQ ID NO: 480) to a 6×HIS-tagged cytoplasmic cutinase. The constructs were linearized with SacI restriction enzyme, transformed into *K. pastoris*, grown and induced as described in example 6.2. Sixteen or twenty four clones were picked for induction. Induced cultures were centrifuged to pellet cells. Uninduced *K. pastoris* was run as a negative control. Cultures were ranked based on color intensity as low (L), medium (M) and high color (H) (FIG. 19).

Figure 20:
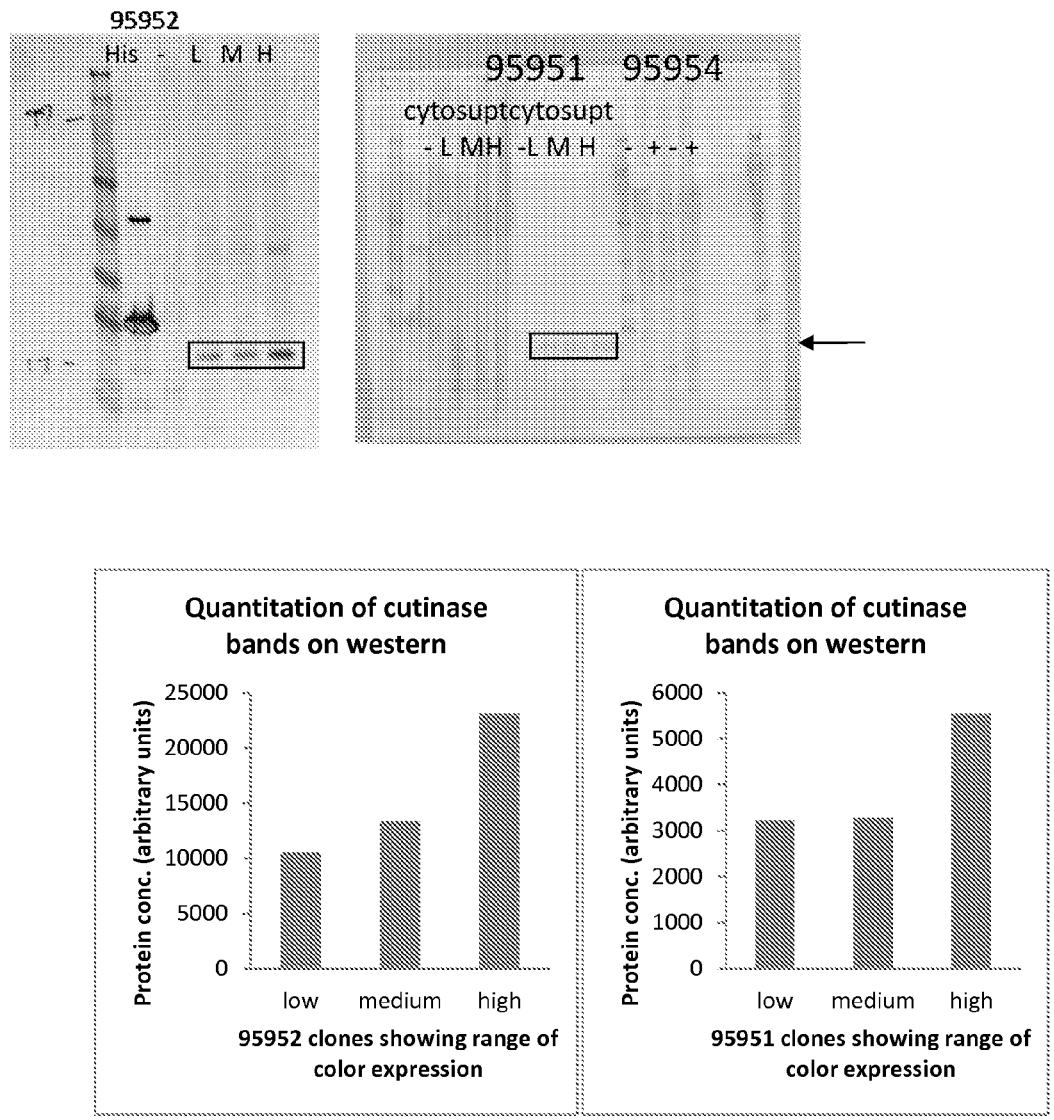

One representative culture from the low, medium and high color intensities was picked for each of the constructs and samples prepared for gel analysis, to run as total cytoplasmic lysates as well as concentrated supernatant (FIG. 20). Western blot was run to detect 6×His tagged cutinase (FIG. 20).

As shown in FIGS. 19 and 20, expression of secreted cutinase increased with higher color intensities for *K. pastoris* transformed with constructs 95951 and 95952. Cutinase expression was linked to color intensity, with higher cutinase expression correlating with more intense color. Thus expression of a colored protein linked by a 2A peptide or CHYSEL sequence to a protein of interest can be used to identify transformants that are expressing high levels of the protein of interest whether the protein of interest is cytoplasmic or secreted.

6.13 Amount of Protein Expressed Correlates Highly with Fluorescence Intensity in *E. coli*

Using different nucleic acid sequences to encode similar or identical proteins can result in expression of very different levels of the protein. If a protein of interest comprises a colored or fluorescent protein, the expression level can be assessed using visible color or fluorescence. This can be used to measure expression properties of the nucleic acids used to encode the protein of interest. It can also be used to identify nucleic acids that result in preferred levels of expression.

Figure 21A:
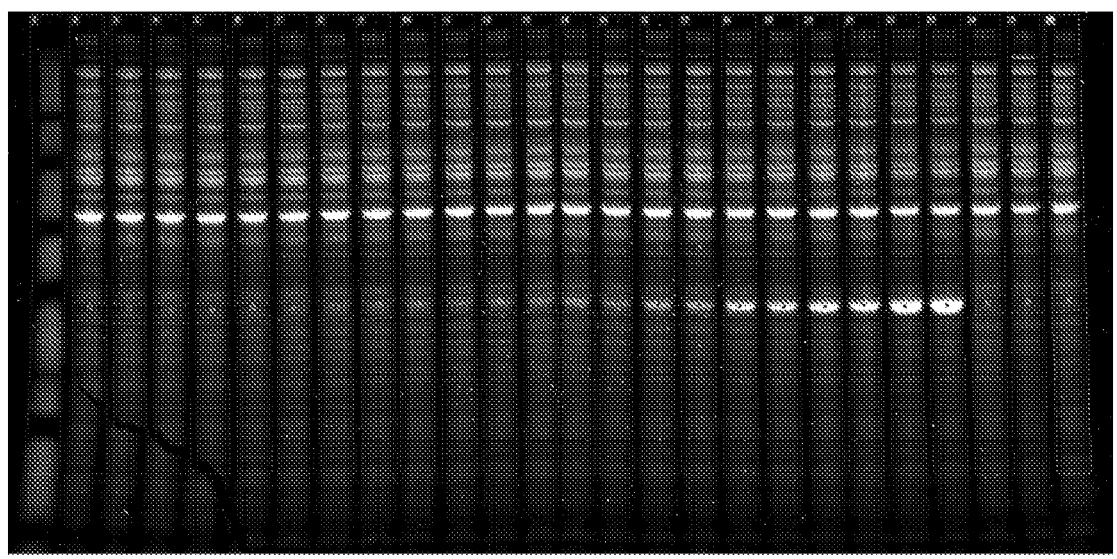
Figure 21B:
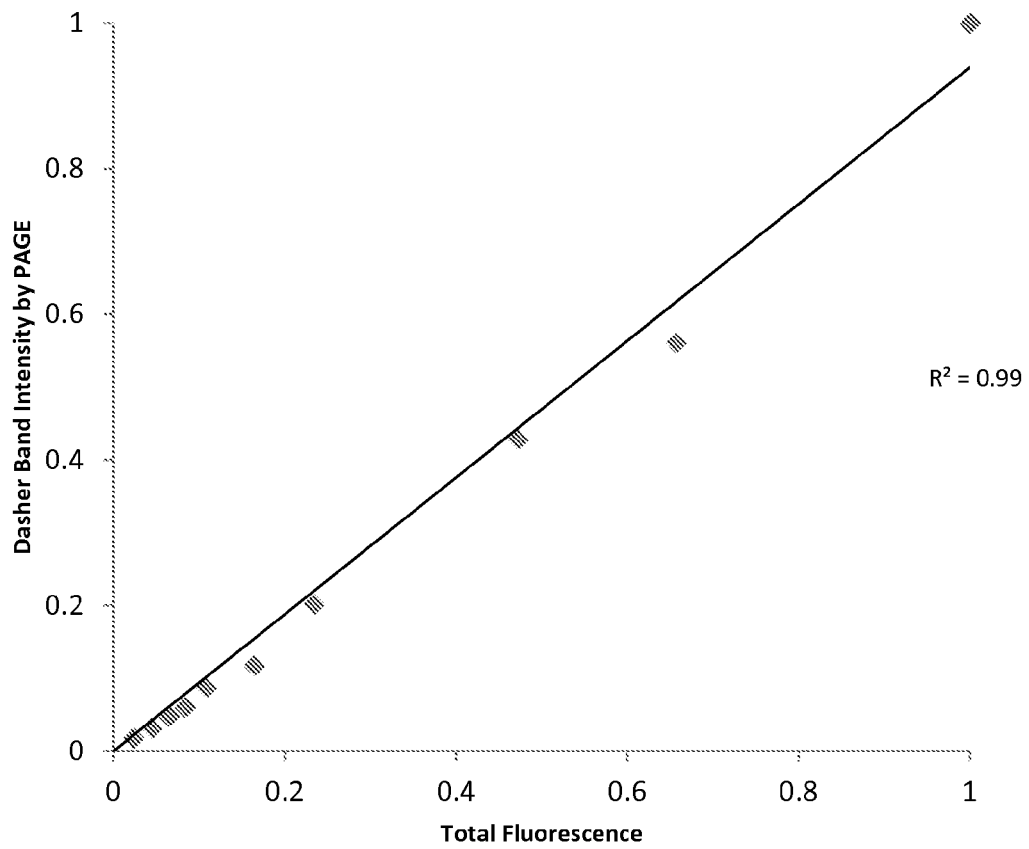
Figure 21C:
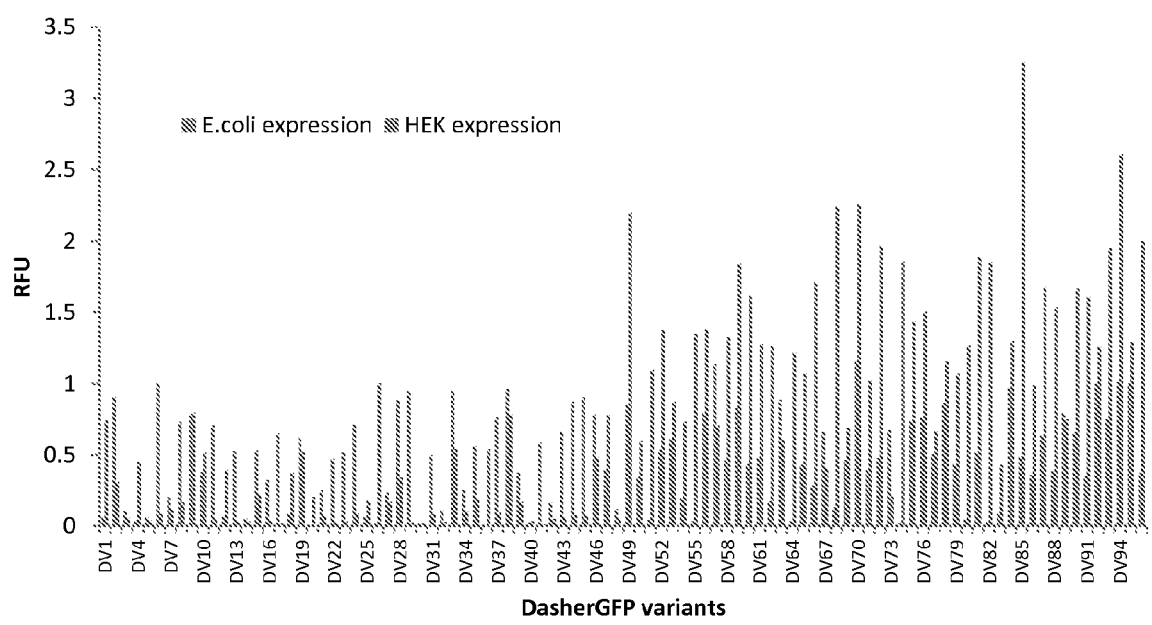

Constructs (SEQ ID NOS: 228-323) used different DNA sequences to encode the same non-natural fluorescent protein DasherGFP (SEQ ID NO: 27). The constructs were cloned under the control of an inducible T5 promoter in a high copy expression vector, transformed into *E coli* strain BL21 and plated on LB agar plates containing 50 µg/ml of kanamycin. Transformants were picked after an overnight incubation at 37° C. and grown overnight at 37° C. in 1200 µl LB medium with 25 µg/ml kanamycin. 300 µl of fresh LB medium with 25 µg/ml kanamycin was inoculated with 10 µl of overnight culture and incubated for 1 hr at 37° C. Cultures were induced for 3 hrs at 37° C. with 1 mM IPTG. Induced cultures were spun down and pellets were resuspended in 2×LDS sample buffer with reducing agent. Samples were denatured at 95° C.

for 10 mins and 5 ul of denatured sample loaded per lane on gel. Protein bands were visualized by staining with Sypro-Ruby from Invitrogen (FIG. 21A). Gels were imaged and protein levels calculated from specific band intensities using TotalLab 120 software from Nonlinear Dynamics. For plate reader, culture pellets were resuspended with A1 re-suspension buffer from Macherey-Nagel. Samples were transferred to opaque 96-well nunc plates and read on a SpectraMax fluorescent plate reader. The data from *E coli* shown in FIGS. 21B and C are an average of duplicate data points.

A comparison of coomassie stained protein intensities on a gel plotted against total fluorescence read on a plate reader (FIG. 21B) showed a very good correlation with a $R^2$ value of 0.99. The amount of protein expressed as measured by band intensity on gel, is directly proportional to fluorescence intensity, showing that fluorescence intensity can be used as a direct measure of the amount of the fluorescent protein that is expressed.

By using different sequences to encode the same colored or fluorescent protein, the effects of different gene design parameters on expression can be explored. Examples of gene design parameters include GC content, 5' mRNA structure, 5' mRNA context, and codon bias. In some embodiments a set comprising 5 or more genes selected from the set of SEQ ID NOS: 228-323 are particularly advantageous in identifying gene design parameters that affect expression.

6.14 Fluorescent Protein Expression can be Used to Indicate the Activity of DNA Sequence Elements Regulating Translational Initiation Using different nucleic acid sequences to control expression of similar or identical proteins can result in expression of very different levels of the protein. If a protein of interest comprises a colored or fluorescent protein, the expression level can be assessed by measuring the level of the colored or fluorescent protein. This can be used to measure expression properties of the nucleic acids used to control expression of the protein of interest. It can also be used to identify nucleic acids that result in preferred levels of expression.

Construct SEQ ID NOS: 358-404 encoded non-natural fluorescent protein DasherGFP (SEQ ID NO: 27), all constructs were identical except for the sequence of the ribosome binding site (RBS) immediately upstream of the colored protein initiation codon. Construct SEQ ID NOS: 405-456 encoded non-natural fluorescent protein KringleYFP (SEQ ID NO: 11), all constructs were identical except for the sequence of the RBS immediately upstream of the colored protein initiation codon. Constructs were cloned under control of an inducible T5 promoter in a high copy vector, transformed into *E coli* strain BL21 and plated on LB agar plates with 50 µg/ml kanamycin. Transformants were picked after an overnight incubation at 37° C. and grown overnight at 37° C. in 1200 µl LB medium with 25 µg/ml kanamycin. 300 µl of fresh LB medium with 25 µg/ml kanamycin was innoculated with 10 µl of overnight culture and incubated for 1 hr at 37° C. Cultures were induced for 3 hrs at 37° C. with 1 mM IPTG. Induced cultures from transformants with the low copy vectors were spun down and pellets were resuspended in 2×LDS sample buffer with reducing agent. Samples were denatured at 95° C. for 10 mins and 5 ul of denatured sample loaded per lane on gel. Protein bands were visualized by staining with SyproRuby from Invitrogen. Gels were imaged and protein levels calculated from specific band intensities using TotalLab120 software from Nonlinear Dynamics.

Figure 22:
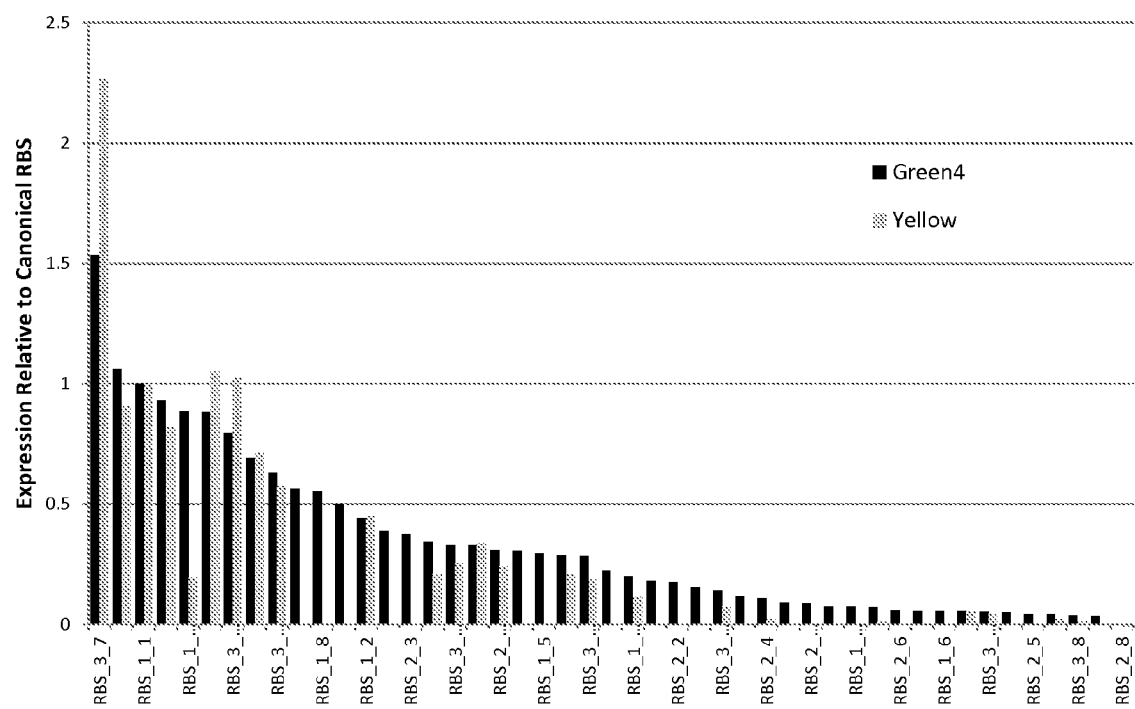
FIG. 22 illustrates color expression as an indicator of RBS strength in E. coli transformed with constructs encoding non-natural fluorescent proteins DasherGFP_Green_4 (SEQ ID NOS: 358-404) or KringleYFP (SEQ ID NOS: 405-456) _Yellow_1. A range of color intensities were observed for the various RBS sequences tested, enabling selection of RBS based on strength.

FIG. 22 shows that the same gene transcribed from the same promoter but with a different RBS yielded very different expression levels. This was true for both DasherGFP and KringleYFP. There was good agreement between the expression of the two different proteins, indicating that this reflected a property of the RBS that is not dependent on the exact sequence of the gene expressed. Data shown is an average of three replicates. The wide range of color expression resulting from the different RBSs shows that non-natural fluorescent proteins can be used as good indicators of the different activities of different synthetic DNA elements for controlling expression.

6.15 Fluorescent Protein Band Intensity on a PAGE Gel Correlates with Total Fluorescence for Constructs with Different RBSs Using different nucleic acid sequences to control expression of similar or identical proteins can result in expression of very different levels of the protein. For example the sequences may alter the rate of initiation of translation. If a protein of interest comprises a colored or fluorescent protein, the expression level can be assessed using visible color or fluorescence. This can be used to measure expression properties of the nucleic acids used to control expression of the protein of interest. It can also be used to identify nucleic acids that result in preferred levels of expression.

Construct SEQ ID NOS: 405-430 encoded non-natural fluorescent protein KringleYFP (SEQ ID NO: 11), all constructs were identical except for the sequence of the RBS immediately upstream of the colored protein initiation codon. Constructs were cloned under control of an inducible T5 promoter in either high or low copy vectors, transformed into *E coli* strain BL21 and plated on LB agar plates with 50 µg/ml kanamycin. Transformants were picked after an overnight incubation at 37° C. and grown overnight at 37° C. in 1200 µl LB medium with 25 µg/ml kanamycin. 300 µl of fresh LB medium with 25 µg/ml kanamycin was innoculated with 10 µl of overnight culture and incubated for 1 hr at 37° C. Cultures were induced for 3 hrs at 37° C. with 1 mM IPTG.

Induced cultures from transformants with the high copy vectors were spun down and pellets were resuspended in 2×LDS sample buffer with reducing agent. Samples were denatured at 95° C. for 10 mins and 5 ul of denatured sample loaded per lane on gel. Protein bands were visualized by staining with SyproRuby from Invitrogen. Gels were imaged and protein levels estimated from specific band intensities using TotalLab 120 software from Nonlinear Dynamics.

Induced cultures from transformants with the low copy vectors were spun down, culture pellets were resuspended with A1 re-suspension buffer from Macherey-Nagel. Samples were transferred to opaque 96-well nunc plates and read on a SpectraMax fluorescent plate reader. Data is an average of triplicate set of data points for measured fluorescence in low copy vector constructs. An average of duplicate data points was used to measure band intensities in high copy vector constructs.

Figure 23:
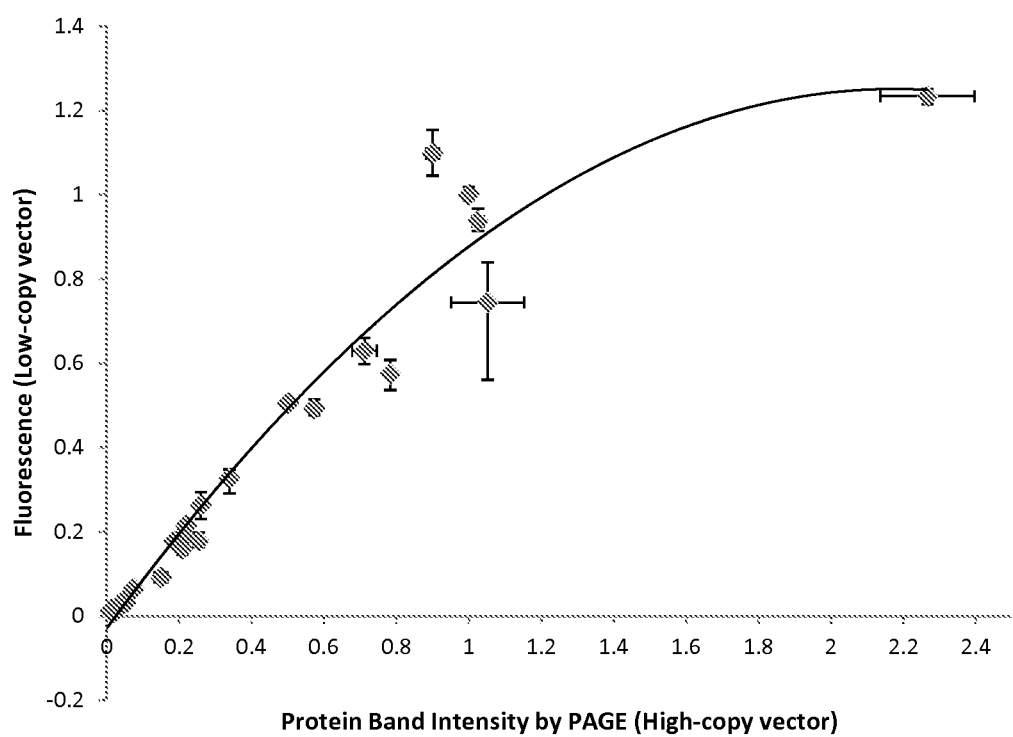
FIG. 23 illustrates the correlation between band intensity by PAGE in high copy vectors and fluorescence intensity in low copy vectors for constructs encoding non-natural fluorescent proteins DasherGFP_Green_4 (SEQ ID NOS: 358-404) or KringleYFP (SEQ ID NOS: 405-456)_Yellow. A good correlation was observed for protein band intensities by polyacrylamide gel and fluorescence intensities.

Fluorescence intensity of constructs expressing KringleYFP with RBSs from low copy vectors was plotted against protein expression determined by PAGE band intensity from high copy vectors (FIG. 23). The two systems gave very good agreement on the effect of the RBS control element on expression. Thus fluorescent proteins are good reporters of protein expression, their fluorescence can be used to measure protein expression levels, and they can be used to assess the activity of genetic elements that control initiation of translation.

6.16 Color Intensity is Linked to Promoter Strength in *E. coli*

Using different nucleic acid sequences to control expression of similar or identical proteins can result in expression of very different levels of the protein. For example the sequences may alter the rate of initiation of transcription. If a protein of interest comprises a colored or fluorescent protein, the expression level can be assessed using visible color or fluorescence. This can be used to measure expression properties of the nucleic acids used to control expression of the protein of interest. It can also be used to identify nucleic acids that result in preferred levels of expression.

Figure 24:
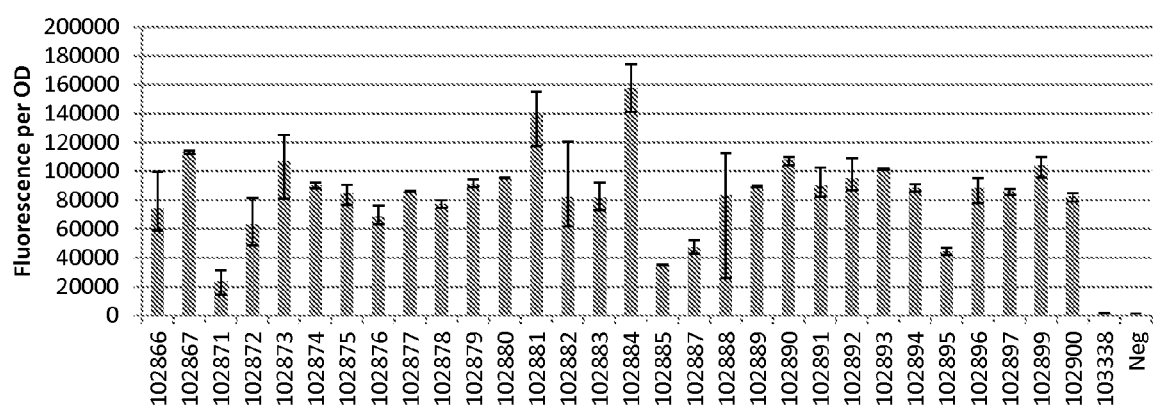
FIG. 24 illustrates color expression as an indicator of promoter strength in E. coli constructs encoding non-natural fluorescent protein DasherGFP (SEQ ID NOS: 324-357). A range of color intensities were observed, enabling selection of promoters based on promoter strength with higher fluorescence intensities indicating higher promoter strength.

Constructs SEQ ID NOS: 324-357 encoded non-natural fluorescent protein DasherGFP (SEQ ID NO: 27), controlled by various constitutive promoters and cloned into a high copy vector. Constructs were identical except for the promoter. Constructs were transformed into *E coli* strain BL21 and plated on LB agar plates with 50 µg/ml kanamycin. Transformants were picked after an overnight incubation at 37° C. and grown overnight at 37° C. in 1200 µl LB medium with 25 µg/ml kanamycin. 300 µl of fresh LB medium with 25 µg/ml kanamycin was innoculated with 10 µl of overnight culture and incubated for 1 hr at 37° C. Cultures were induced for 3 hrs at 37° C. with 1 mM IPTG. Induced cultures were spun down and pellets were resuspended with A1 re-suspension buffer from Macherey-Nagel. Samples were transferred to opaque 96-well nunc plates and read on a SpectraMax fluorescent plate reader. O.D was determined for all the induced cultures. Fluorescence was normalized to density of culture and intensity plotted for all the different promoters tested (FIG. 24). As seen in FIG. 24, promoter constructs 102881 (promoter and DasherGFP DNA sequence SEQ ID NO: 338) and 102884 (promoter and DasherGFP DNA sequence SEQ ID NO: 341) showed highest expression corresponding to highest promoter strength; constructs 102871 (promoter and DasherGFP DNA sequence SEQ ID NO: 328), 102885 (promoter and DasherGFP DNA sequence SEQ ID NO: 342), 102887 (promoter and DasherGFP DNA sequence SEQ ID NO: 343) and 102895 (promoter and DasherGFP DNA sequence SEQ ID NO: 351) showed the lowest promoter strength and the remaining constructs were of medium strength. A fluorescent protein is thus a convenient reporter to assess the activity of sequence elements controlling expression by effects on initiation of transcription, in this case promoters.

6.16 Bicistronic Expression of RudolphRFP and CometGFP Linked by an IRES

Expression of a protein of interest can be assessed in a mammalian cell by monitoring the expression of a fluorescent protein by visible fluorescence. A single expression construct polynucleotide encodes the protein of interest, an IRES sequence and a fluorescent protein. Cells with higher expression of the protein of interest can be identified by selecting cells that produce the most fluorescence, either by visual inspection under a microscope, or by flow cytometry. It may be particularly advantageous if the expression construct is flanked by sequences that direct integration into the chromosome using an integrase or a recombinase.

Construct 96606 (SEQ ID NO: 461) and 96607 (SEQ ID NO: 462) both encoded non-natural fluorescent protein RudolphRFP (SEQ ID NO 215) linked by an IRES element (SEQ ID NO: 459) to non-natural fluorescent protein CometGFP (SEQ ID NO: 25) in a piggyBac integration vector, with either blasticidin (96606) or puromycin (96607) resistance markers. Cells from an HEK293 derivative cell line grown in DMEM media supplemented with 10% heat-inactivated fetal bovine serum, 1× Glutamax and 1× Non-essential amino acids were transfected with the constructs using a standard lipid reagent.

Transfected cells were selected with 30 ug/mL blasticidin (construct 96606) or 2 ug/mL puromycin (construct 96607). Selection was continued for 7 days before cells were replated in media minus antibiotics for an additional 48 hrs before taking pictures. All pictures were taken at 100× magnification.

In HEK293 cells transfected with construct 96607, both RudolphRFP and CometGFP showed good expression. Over 90% of cells showed expression of the fluorescent proteins indicating high levels of integration of the piggyBac vector plasmid. HEK293 cells appeared yellow where cells expressed both RudolphRFP and CometGFP. Visual inspection of the pattern of highly green fluorescent cells with those that were highly red fluorescent showed the two to be the same. Expression of RudolphRFP and CometGFP linked by an IRES element in a vector integrated using the piggyback integrase appeared equivalent.

A similar result was observed for construct 96606.

Replacing the one of the fluorescent proteins with a gene of interest would allow quick real-time expression readout of level of expression of gene of interest by following expression of the remaining fluorescent protein, avoiding the need for time consuming cell lysis and gel analysis. Thus a fluorescent protein linked though an IRES to a protein of interest can serve as a good indicator of the expression levels of the protein of interest. This thus allows the identification and/or isolation of cells where a genetic construct is producing desirable expression levels of a protein of interest.

6.17 Bicistronic Expression of CometGFP and mRFP Linked by a 2A Element

Expression of a protein of interest can be assessed in a mammalian cell by monitoring the expression of a fluorescent protein by visible fluorescence. A single expression construct polynucleotide encodes the protein of interest, a CHYSEL or 2A peptide sequence and a fluorescent protein, all in the same reading frame. Cells with higher expression of the protein of interest can be identified by selecting cells that produce the most fluorescence, either by visual inspection under a microscope, or by flow cytometry.

Construct 100433 (SEQ ID NO: 468) encoded non-natural fluorescent proteins CometGFP fused with a nuclear localization signal, linked by a TAV2A CHYSEL sequence (SEQ ID NO: 101, encoded by SEQ ID NO: 458) to mRFP fused with a CAAX cytoplasmic localization tag, all cloned into a piggyBac integration vector. Cells from an HEK293 derivative cell line grown in DMEM media supplemented with 10% heat-inactivated fetal bovine serum, 1× Glutamax and 1× Non-essential amino acids were transfected with the construct using a standard lipid reagent. Cells were grown for 48 hrs and selected with 2 ug/mL puromycin. Selection was continued for 7 days before cells were replated in media minus antibiotics for an additional 48 hrs before taking pictures. All pictures were taken at 200× magnification.

In HEK293 cells transfected with construct 100433, both CometGFP and mRFP showed good expression. CometGFP was expressed and localized in the nucleus and mRFP showed cytoplasmic expression and localization. Over 90% of cells showed expression of the fluorescent proteins indicating high levels of integration of the piggyBac vector plasmid. The 2A element allowed equal levels of coexpression of the two fluorescent proteins.

An overlay of CometGFP and mRFP expression in HEK293 cells, showed that CometGFP was seen only in the nucleus with mRFP only present in the cytoplasm. The different localizations showed that even though the proteins are encoded linked with the 2A CHYSEL sequence as a single continuous polypeptide, the proteins were expressed as separate polypeptides. Western blotting showed that less than 3% of the protein was present as a fusion. Levels of proteins linked by the 2A element were very similar and the two fluorescent proteins were efficiently cleaved as observed by their localization to various cellular compartments.

Replacing one of these fluorescent proteins with a gene of interest would allow quick real-time expression readout of level of expression of gene of interest by following expression of the remaining fluorescent protein, avoiding the need for time consuming cell lysis and gel analysis. Thus a fluorescent protein linked though aCHYSEL or 2A peptide sequence element to a protein of interest can serve as a good indicator of the expression levels of the protein of interest. This allows the identification and/or isolation of cells where an integrated genetic construct is producing desirable expression levels of a protein of interest.

6.18 Bicistronic Expression of CometGFP and RudolphRFP Linked by a 2A Element in a CMV Mammalian Vector System Expression of a protein of interest can be assessed in a mammalian cell by monitoring the expression of a fluorescent protein by visible fluorescence. A single expression construct polynucleotide encodes the protein of interest, a CHYSEL or 2A peptide sequence and a fluorescent protein, all in the same reading frame. Cells with higher expression of the protein of interest can be identified by selecting cells that produce the most fluorescence, either by visual inspection under a microscope, or by flow cytometry. This can be particularly advantageous when the expression construct lacks a highly efficient method for genomic integration because expression of the fluorescent protein is very tightly linked to expression of the protein of interest.

Construct 91168 (SEQ ID NO: 469) encoded non-natural fluorescent proteins CometGFP (SEQ ID NO: 25) fused with a nuclear localization signal, linked by a TAV2A CHYSEL sequence (SEQ ID NO: 101 encoded by SEQ ID NO: 458) to RudolphRFP (SEQ ID NO 215) fused with a CAAX cytoplasmic localization tag, all cloned under control of the CMV promoter in a mammalian expression vector.

An HEK293 derivative cell line was grown in DMEM media supplemented with 10% heat-inactivated fetal bovine serum, 1× Glutamax and 1× Non-essential amino acids. Cells were transfected with the construct using a standard lipid reagent, grown for 48 hrs and selected with 2 ug/mL puromycin. Selection was continued for 7 days before cells were replated in media minus antibiotics for an additional 48 hrs before taking pictures. All pictures were taken at 200× magnification.

In HEK293 cells transfected with construct 91168 CometGFP and RudolphRFP were well expressed. CometGFP was localized in the nucleus and RudolphRFP showed spotted cytoplasmic localization. The different localizations showed that even though the proteins were encoded linked with the 2A CHYSEL sequence as a single continuous polypeptide, the proteins were expressed as separate polypeptides. The 2A element allowed coexpression and good separation of the two fluorescent proteins. An overlay picture of CometGFP and RudolphRFP expressed in HEK293 cells showed CometGFP only in the nucleus and RudolphRFP only in the cytoplasm. Levels of proteins linked by the 2A element were very similar.

Replacing one of these fluorescent proteins with a gene of interest would allow quick real-time expression readout of level of expression of gene of interest by following expression of the remaining fluorescent protein, avoiding the need for time consuming cell lysis and gel analysis. Thus a fluorescent protein linked though a CHYSEL or 2A peptide sequence element to a protein of interest can serve as a good indicator of the expression levels of the protein of interest. This allows the identification and/or isolation of cells where a genetic construct is producing desirable expression levels of a protein of interest.

6.19 Expression of DasherGFP and RudolphRFP in a Lentivirus Vector System

Gene construct 95748 (SEQ ID NO: 466) encoded non-natural fluorescent protein DasherGFP (SEQ ID NO: 27); construct 97546 (SEQ ID NO: 467) encoded non-natural fluorescent protein RudolphRFP (SEQ ID NO 215) in a lentiviral vector were packaged using standard methods and viral supernatant harvested after 48 hrs. An HEK293 cell line was infected at an MOI (multiplicity of infection) of approximately 1 and selected with 25 µg/mL blasticidin. Greater than 90% of blasticidin resistant cells transfected with construct 95748 were positive for DasherGFP. Greater than 90% of blasticidin resistant cells transfected with construct 95746 were positive for RudolphRFP. Fluorescent proteins can thus be expressed from lentiviral vectors to determine expression in the cell line of interest. Fluorescent proteins linked though a CHYSEL or 2A peptide sequence element to a protein of interest can also serve as a good indicator of the expression levels of the protein of interest.

6.20 Mutations that have the Potential to Improve Desirable Biological Properties of Fluorescent Proteins Fluorescent proteins: Cyan__1 (SEQ ID NO: 12), Red__3_Rudolph (SEQ ID NO: 95), Green__2_Comet (SEQ ID NO: 25) and Yellow__6 (SEQ ID NO: 75) were aligned to various GFP or RFP forms reported in literature (Zaccharias et al., Science 296, 913, 2002; Zhang et al., Nat. Methods, 2012; Campbell et al., PNAS, vol 99, no 12: 7877-7882, 2002; Tasdemir et al., Prot. Eng. Des & Sel, vol. 21 no. 10:613-622, 2008) to modify the multimeric state of the proteins. The reported GFP or RFP fluorescent proteins were modified using amino acid substitutions based on crystallographic studies, fluorescence resonance energy transfer measurements or site directed mutagenesis studies to convert oligomeric or dimeric forms to monomeric forms. Following examples cited in literature, we aligned our fluorescent proteins to improved GFP and RFP versions to identify substitutions in amino acid residues most likely to result in monomeric states. For example, Cyan__1 can be aligned (SEQ ID NO: 12) with GFP (Zacharias et al., Science 296, 913, 2002), MeOS2 (Zhang et al., Nat. Methods, 2012), DsRed (Campbell et al., PNAS, vol 99, no 12: 7877-7882, 2002) and AsGFP499 (Tasdemir et al., Prot. Eng. Des & Sel, vol. 21 no. 10:613-622, 2008).

Zacharias et al. identified three amino acid substitutions A206K, L221K and F223R that allowed partitioning of lipid modified monomeric GFPs in membrane microdomains of live cells. On alignment with Cyan__1 (SEQ ID NO: 12) we identified amino acid positions 209K, 224V and 226V corresponding to the above identified substitutions that may benefit from substitutions. Similarly, red_3_Rudolph (SEQ ID NO: 95) can be aligned with GFP, this allowed us to identify amino acids 200V, 211Q and 213H in red_3_Rudolph. Alignment of green_2_Comet (SEQ ID NO: 25) with GFP identified amino acids 209S, 225V and 227V and alignment of yellow_6 (SEQ ID NO: 75) with GFP identified amino acids 209T, 224V and 226V that could potentially benefit with substitutions leading to monomeric states and or increased fluorescence properties.

Studies by Zhang et al. looking at rational design of true monomeric and bright photoactivatable fluorescent proteins and examining residue-residue interactions at two interfaces identified two key residues I102N and Y189A that may participate in oligomerization of mEos2, a green-to-red photoactivable fluorescent protein. Alignment of Cyan_1 (SEQ ID NO: 12) with mEos2 identified amino acid positions 108K and 201Y corresponding to the above identified substitutions. Similarly, alignment of red_3_Rudolph (SEQ ID NO: 95) with mEos2 identified amino acids 106T and 192N, alignment of green_2_Comet (SEQ ID NO: 25) to mEos2 identified amino acids 108K and 201Y and alignment of yellow_6 (SEQ ID NO: 75) to mEos2 identified amino acids 108K and 201Y that could potentially benefit with substitutions leading to monomeric states and or increased fluorescence properties.

Studies by Campbell et al. looking at directed evolution and characterization of a monomeric red fluorescent protein identified several key residues-I125R that results in a weak dimer or V127T and I180T at the AB interface and residues R153E, H162K, A164R, L174D, Y192A, Y194K, H222S, L223T, F224G and L225A at the AC interface that allowed monomerization. Alignment of Cyan_1 (SEQ ID NO: 12) with DsRed identified amino acid positions shown in parentheses and highlighted corresponding to the above identified substitutions. Similarly, alignment of red_3_Rudolph (SEQ ID NO: 95) with DsRed identified amino acids shown in parentheses and highlighted, alignment of green_2_Comet (SEQ ID NO: 25) with DsRed identified amino acids shown in parentheses and highlighted and alignment of yellow_6 (SEQ ID NO: 75) with DsRed identified amino acids shown in parentheses and highlighted that could potentially benefit with substitutions leading to monomeric states and or increased fluorescence properties.

Studies by Tasdemir et al. looking at site directed mutagenesis of a tetrameric green fluorescent protein from the sea anemone *Anemonia sulcata* $AsGFP_{499}$ and conversion to its dimeric and monomeric forms, identified three key residues S103K, T159K and F173E that allowed monomerization. Alignment of Cyan_1 (SEQ ID NO: 12) with $AsGFP_{499}$ identified amino acid positions 108K, 167N and 182K corresponding to the above identified substitutions. Similarly, alignment of red_3_Rudolph (SEQ ID NO: 95) with $AsGFP_{499}$ identified amino acids 106T, 161V and 176Q, alignment of green_2_Comet (SEQ ID NO: 25) with $AsGFP_{499}$ identified amino acids 108K, 165A and 179F and alignment of yellow_6 (SEQ ID NO: 75) with $AsGFP_{499}$ identified amino acids 108K, 165A and 179F that could potentially benefit with substitutions leading to monomeric states and or increased fluorescence properties.

Directed mutagenesis studies, rational design and directed evolution may all be used individually or in combination to create versions of the colored or fluorescent proteins described here, (including any of SEQ ID NOS: 1-99, 161, 171, 175, 177, 179, 181, 183, 185, 187, 189, 213, 215, 217, 219 or 483-510) monomeric versions of fluorescent proteins with additional desirable physical properties like brightness, photostability, maturation etc. This would greatly broaden their potential usefulness in biological applications especially in microscopy and FRET applications where monomeric states are desirable.

6.22 Fluorescent Proteins can be Used in Prokaryotic and Eukaryotic Cells to Identify Gene Design Parameters that Affect Protein Expression Some embodiments comprise a plurality of five or more expression cassettes, wherein each expression cassette comprises a first polynucleotide sequence and a second polynucleotide sequence, and wherein each respective second polynucleotide comprises a sequence encoding a polypeptide comprising a non-natural chromo- or fluorescent protein (for example any of SEQ ID NOS: 1-99, 161, 171, 175, 177, 179, 181, 183, 185, 187, 189, 213, 215, 217, 219 or 483-510) and the sequence of each respective second polynucleotide in the plurality of second polynucleotides encodes a respective single polypeptide sequence the entirety of which is at least ninety-five percent identical to the entirety of the respective single polypeptide sequence encoded by each other second polynucleotide in the plurality of second polynucleotides. The first polynucleotide in each expression cassette comprises a transcriptional initiation sequence, each respective first polynucleotide sequence is identical to the first polynucleotide sequence of each other expression cassette in the plurality of expression cassettes. The plurality of expression cassettes are introduced into a host cell, and the color or fluorescence of the host cell is used to assess the expression of the polypeptide. Expression of the polypeptide is used to identify second polynucleotides that express more highly. In some embodiments, the host cell is a eukaryotic host. In certain embodiments the host cell is a mammalian cell.

Constructs (SEQ ID NOS: 228-323) used different DNA sequences to encode the same non-natural fluorescent protein DasherGFP (SEQ ID NO: 27). The constructs were cloned under the control of T5 promoter for *E. coli* expression and CMV promoter in a transient expression vector, transformed into HEK293 cells using a standard lipid reagent.

By using different sequences to encode the same colored or fluorescent protein, the effects of different gene design parameters on expression can be explored. Examples of gene design parameters include GC content, 5' mRNA structure, 5' mRNA context, and codon bias. In some embodiments a set comprising 5 or more genes selected from the set of SEQ ID NOS: 228-323 are particularly advantageous in identifying gene design parameters that affect expression.

7. REFERENCES

All references cited herein are incorporated herein by reference in their entirety and for all purposes to the same extent as if each individual publication or patent or patent application was specifically and individually indicated to be incorporated by reference in its entirety for all purposes.

Many modifications and variations of this invention can be made without departing from its spirit and scope, as will be apparent to those skilled in the art. The specific embodiments described herein are offered by way of example only, and the invention is to be limited only by the terms of the appended claims, along with the full scope of equivalents to which such claims are entitled.

SEQUENCE LISTING (556 sequences)

SEQ ID NO: 1 - protein, 228 aa, Escherichia coli
MASLVKKDMCIKMTMEGTVNGYHFKCVGEGEGKPFEGTQNMRTRVTEGGPLPFAFDILAPCCMYGSKTFIKHVSGIPDYFKESFPEGFTWERTQIFEDGGVLTAHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAEQGKFYEQYESAVARYSDVPEKAT

SEQ ID NO: 2 - protein, 232 aa, Escherichia coli
MASKISDNVRIKLYMEGTVNGHYFKCTGKGEGNPFEGTQEMKIEVIEGGPLPFSFDILTPNCQYGSVAITKYTSGIPDYFKQSFPEGFTWERTTIYEDGGVLTAHQDTSLEGNCLVYNIKILGCNFPPNGPVMQKKTQGWEPCCEMRYTRDGVLCGQTLMALKCADGNHLTCHLRTTYRSKKAAKALQMPPFHFSDHRPEIVKVSENGTLFEQHESSVARYCQTCPSKLGHN

SEQ ID NO: 3 - protein, 231 aa, Escherichia coli
MASLVKKDMCIKMTMEGTVNGHHFKCVGEGEGKPFEGTQVEKIRITEGGPLPFAYDILAPCCMYGSKTFIKHVSGIPDYFKESFPEGFTWERTQIFEDGGYLTIHQDTSLQGNNFIFKVNVIGANFPANGPVMQKKTAGWEPCVEMLYPRDGVLCGQSLMALKCTDGNHLTSHLRTTYRSRKPSNAVNMPEFHFGDHRIEILKAEQGKFYEQYESAVARYCEAAPSKLGHH

SEQ ID NO: 4 - protein, 231 aa, Escherichia coli
MASLVKKDMCIKMTMEGTVNGHHFKCVGEGEGKPFEGTQNMRIRVTEGAPLPFAFDILSPCCAYGSKTFIKHVSGIPDYFKESFPEGFTWERTTIYEDGGVLTAHQDTSLEGNCLIYKVKVLGTNFPADGPVMKKISGGWEPCVEMLYPRDGVLCGQSLMALKCTDGNHLTSHLRTTYRSRKPSNAVNMPEFHFGDHRIEILKAEQGKFYEQYESAVARYCEAAPSKLGHH

SEQ ID NO: 5 - protein, 228 aa, Escherichia coli
MASLVKKDMCIKMTMEGTVNGYHFKCVGEGEGKPFEGTQNMRIRVTEGGPLPFAFDILAPCCMYGSKTFIKHVSGIPDYFKESFPEGFTWERTQIFEDGGVLTAHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAEQGKFYEQYESAVARYSDVPEKAT

SEQ ID NO: 6 - protein, 228 aa, Escherichia coli
MASLVKKDMCIKMTMEGTVNGYHFKCEGEGDGNPFEGTQNMRIRVTEGAPLPFAYDILAPCCMYGSKTFIKHTSGIPDYFKESFPEGFTWERTTIYEDGGYLTIHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAEQGKFYEQYESAVARYSDVPEKAT

SEQ ID NO: 7 - protein, 231 aa, Escherichia coli
MSKISDNVRIKLYMEGTVNNHHFMCEAEGEGKPYEGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKAERWEPATEILYEVDGVLRGQTLMALKCADGNHLTCHLRTTYRSKKPASALKMPGFHFGDHRIEIMEEVEKGKCYKQYEAAVARYCDAAPSKLGHH

SEQ ID NO: 8 - protein, 228 aa, Escherichia coli
MASLVKKDMCIKMTMEGTVNGYHFKCVGEGEGKPFEGTQNTRIRVTEGGPLPFAFDILAPCCMYGSKTFIKHVSGIPDYFKESFPEGFTWERTQIFEDGGVLTAHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAERGKFYEQYESAVARYSDVPEKAT

SEQ ID NO: 9 - protein, 228 aa, Escherichia coli
MASLVKKDMCVKMTMEGTVNGYHFKCVGEGEGKPFEGTQNMRIRVTEGGPLPFAFDILAPCCMYGSKTFIKHVSGIPDYFKESFPEGFTWERTQIFEDGGVLTAHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAEQGKFYEQYESAVARYSDVPEKAT

SEQ ID NO: 10 - protein, 231 aa, Escherichia coli
MASLVKKDMCIKMTMEGTVNGHHFKCVGEGEGKPFEGTQNMRIRVTEGAPLPFAYDILAPCCMYGSKTFIKHTSGIPDYFKQSFPEGFTWERTQIFEDGGYLTIHQDTSLQGNNFIFKVNVIGANFPANGPVMQKKTAGWEPCVEMLYPRDGVLCGQSLMALKCTDGNHLTSHLRTTYRSRKPSNAVNMPEFHFGDHRIEILKAEQGKFYEQYESAVARYCEAAPSKLGHH

SEQ ID NO: 11 - protein, 236 aa, Escherichia coli
MTALTEGAKLFEKEIPYITELEGDVEGMKFIIKGEGTGDASVGKVDAQFICTTGDVPVPWSTLVTTLTYGAQCFAKYPRHIADFFKSCMPEGYVQERTITFEGDGVFKTRAEVTFENGSVYNRVKLNGQGFKKDGHVLGKNLEFNFTPHCLYIWGDQANHGLKSAFKIMHEITGSKEDFIVADHTQMNTPIGGGPVHVPEYHHITYHVTLSKDVTDHRDHLNIVEVIKAVDLETYR

SEQ ID NO: 12 - protein, 236 aa, Escherichia coli
MTALTEGTKLFEKEIPYITELEGDVNGMKFTIHGKGTGDATTGTIKAKYICTTGDLPVPWATLVSTLSYGVQCFAKYPSHIKDFFKSAMPEGYVQERTITFEGDGVFKTRAEVTFENGSVYNRVKLNGQGFKKDGHILRKNVAFQCPPDMVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 13 - protein, 233 aa, Escherichia coli
MSSGALLFTNKIPYVTELEGDVNGMKFTIHGKGTGDASVGKVDAQFICTTGDVPVPWATLVSTLSYGVQCFAKYGPELKDFYKSCMPEGYVQERTITFEGDGVFKTRAEVTFENGSVYNRVTLTGENFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 14 - protein, 233 aa, Escherichia coli
MSSGAKLFEKKIPYITELEGDVNGMKFTIHGKGTGDASTGTVKAQFICTTGDLPVPWATLVSTLSYGVQCFAKYPSHIKDFFKSCMPEGYVQERTITFEGDGVFKTRAEVTFESGSVYNRVTLTGQGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 15 - protein, 233 aa, Escherichia coli
MSSGTKLFTKKIPYITELEGDVNGMKFTIHGKGTGDATVGKVKAQFICTTGDVPVPWATLVSTLSYGVQCFAKYPSHIKDFFKSCMPEGYVQERTITFEGDGVFKTRAEVTFENGSVYNRVKLTGEGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 16 - protein, 233 aa, Escherichia coli
MSSGALLFTKKIPYITELEGDVNGMKFTIHGKGTGDATVGKIDAQFICTTGDLPVPWATLVSTLSYGVQCFAKYPSHIKDFFKSCMPEGYVQERTITFEGDGVFKTRAEVTFENGSVYNRVKLTGQGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 17 - protein, 233 aa, Escherichia coli
MSSGTKLFTKEIPYVTELEGDVNGMKFTIHGKGTGDASTGTIKAKYICTTGDLPVPWATLVSTLSYGVQCFAKYPPEIKDFFKSAMPEGYVQERTITFEGDGVFKTRAEVTFENGSVYNRVTLTGQGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 18 - protein, 233 aa, Escherichia coli
MSSGTKLFEKEIPYVTELEGDVNGMKFTIHGKGTGDATTGKIDAQYICTTGDLPVPWATLVSTLSYGVQCFAKYPPHIKDFFKSCMPEGYVQERTITFEGDGVFKTRAEVTFENGSVYNRVKLNGEGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 19 - protein, 233 aa, Escherichia coli
MSSGTKLFEKEIPYITELEGDVNGMKFTIHGKGTGDATVGKVDAQFICTTGDLPVPWATLVSTLSYGVQCFAKYPPHIKDFFKSCMPEGYVQERTITFEGDGVFKTRAEVTFENGSVYNRVKLNGQGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 20 - protein, 236 aa, Escherichia coli
MTALTEGTKLFEKEIPYITELEGDVNGMKFTIHGKGTGDATTGTVKAKFICTTGDVPVPWATLVSTLSYGVQCFAKYPPELKDFFKSCMPEGYVQERTITFEGDGVFKTRAEVTFENGSVYNRVKLTGEGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 21 - protein, 236 aa, Escherichia coli
MTALTEGTKLFEKKIPYVTELEGDVNGMKFTIHGKGTGDASTGTVKAKYICTTGDLPVPWATLVSTLSYGVQCFAKYPPHLKDFYKSAMPEGYVQERTITFEGDGVFKTRAEVTFENGSVYNRVTLNGQGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 22 - protein, 236 aa, Escherichia coli
MTALTEGTKLFTKEIPYVTELEGDVNGMKFTIHGKGTGDATVGKVKAKFICTTGDLPVPWATLVSTLSYGVQCFAKYPPHIKDFYKSCMPEGYVQERTITFEGDGVFKTRAEVTFENGSVYNRVTLTGETFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 23 - protein, 236 aa, Escherichia coli
MTALTEGALLFENEIPYITELEGDVNGMKFTIHGKGTGDASVGKVDAQFICTTGDVPVPWATLVSTLSYGVQCFAKYPPHIKDFFKSCMPEGYVQERTITFEGDGVFKTRAEVTFENGSVYNRVKLNGEGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 24 - protein, 234 aa, Escherichia coli
MSSGALLFHGKIPYVVEMEGNVDGHTFSIRGKGYGDASVGKVDAQFICTTGDVPVPWSTLVTTLTYGAQCFAKYAPGLKDFYKSCMPEGYVQERTITFEGDGVFKTRAEVTFENGSVYNRVKLNGQGFKKDGHVLGKNLKFNFTPHCLYIWGDQANHGLKSAFKIMHEITGSKEDFIVADHTQMNTPIGGGPVHVPEYHHLTVWTSFGKDPDDDETDHLNIVEVIKAVDLETYR

SEQ ID NO: 25 - protein, 237 aa, Escherichia coli
MTALTEGAKLFEKEIPYITELEGDVEGMKFIIKGEGTGDATTGTIKAKYICTTGDVPVPWSTLVTTLTYGAQCFAKYGPELKDFYKSCMPEGYVQERTITFEGDGVFKTRAEVTFENGSVYNRVKLNGQGFKKDGHVLGKNLEFNFTPHCLCIWGDQANHGLKSAFKIMHEITGSKEDFIVADHTQMNTPIGGGPVHVPEYHHLTVWTSFGKDPDDDETDHLNIVEVIKAVDLETYR

SEQ ID NO: 26 - protein, 233 aa, Escherichia coli
MSSGALLFTNKIPYVTELEGDVNGMKFTIHGKGTGDASVGKVDAKFICTTGDVPVPWATLVSTLSYGVQCFAKYGPELKDFYKSCMPEGYVQERTITFEGDGVFKTRAEVTFENGSVYNRVTLTGENFKKDGHILRKNVAFQCPPSILYILPDTVNNGIRVEFNQAYDIEGVTEKLVTRCSQMNRPLAGSAAVHIPRYHHLSKHTKLSKDRDERRDHMCLVEVVKAVDLDTYQ

SEQ ID NO: 27 - protein, 236 aa, Escherichia coli
MTALTEGAKLFEKEIPYITELEGDVEGMKFIIKGEGTGDATTGTIKAKYICTTGDLPVPWATLVSTLSYGVQCFAKYPSHIKDFFKSAMPEGYTQERTISFEGDGVYKTRAMVTYERGSIYNRVTLTGENFKKDGHILRKNVAFQCPPSILYILPDTVNNGIRVEFNQAYDIEGVTEKLVTKCSQMNRPLAGSAAVHIPRYHHITYHTKLSKDRDERRDHMCLVEVVKAVDLDTYQ

SEQ ID NO: 28 - protein, 246 aa, Escherichia coli
MTALTEGAKLFEKEIPYVTELEGDVEGMKFIIKGEGTGDASVGKVDAQFICTTGDLPVPWSTLVTTLTYGAQCFAKYGPELKDFYKSCMPEGYTQERTISFEGDGVFKTRAEVTFENGSVYNRVKLNGQGFKKDGHVLGKNLEFNFTPHCLYIWGDQANHGLKSAFKICHEITGSKGDFIVADHTQMNTPIGGGPVHVPEYHHITYHVTLSKDVTDHRDNMSLKETVRAVDCRKTYDFDAGSGDTR

SEQ ID NO: 29 - protein, 235 aa, Escherichia coli
MSSAGALLFTNKIPYVTELEGDVNGMKFTIHGKGTGDASTGNIEAKYVCTSGEIPVPWSTLVTTLTYGAQCFAKYGPELKDFYKSCMPEGYTQERTISFEGDGVFKTRAEVTFENGSVYNRVTLTGENFKKDGHVLGKNLEFNFTPHCLYIWGDQANHGLKSAFKIMHEITGSKEDFIVADHTQMNTPIGGGPVHVPEYHHITYHVTLSKDVTDHRDNMSLVETVRAVDCRKTYL

SEQ ID NO: 30 - protein, 233 aa, Escherichia coli; identical to SEQ ID NO: 13

SEQ ID NO: 31 - protein, 234 aa, Escherichia coli
MSSGALLFHGKIPYVVEMEGNVDGHTFSIRGKGYGDASVGKVDAQFICTTGDVPVPWSTLVTTLTYGAQCFAKYGPGLKDFYKSCMPEGYVQERTITFEGDGVFKTRAEVTFENGSVYNRVKLNGQGFKKDGHVLGKNLEFNFTPHCLYIWGDQANHGLKSAFKIMHEITGSKEDFIVADHTQMNTPIGGGPVHVPEYHHLTVWTSFGKDPDDDETDHLNIVEVIKAVDLETYR

SEQ ID NO: 32 - protein, 228 aa, Escherichia coli
MASLVKKDMCIKMTMEGTVNGYHFKCVGEGEGKPFEGTQVEKIRITEGGPLPFAYDILAPCCMYGSKTFIKHVSGIPDYFKESFPEGFTWERTTIYEDGGVLTAHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAEQGKFYEQYESAVARYSDVPEKAT

SEQ ID NO: 33 - protein, 233 aa, Escherichia coli
MSSGTLLFTKKIPYITELEGDVNGMKFTIHGKGTGDATVGKIKAKFICTTGDVPVPWATLVSTLSYGVQCFAKYPSELKDFFKSCMPEGYVQERTITFEGDGVFKTRAEVTFENGSVYNRVTLNGQGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 34 - protein, 233 aa, Escherichia coli
MSSGALLFTKEIPYITELEGDVNGMKFTIHGKGTGDATTGTVKAKYICTTGDVPVPWATLVSTLSYGVQCFAKYPSEIKDFFKSCMPEGYVQERTITFEGDGVFKTRAEVTFENGSVYNRVKLTGQGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 35 - protein, 233 aa, Escherichia coli
MSSGAKLFENEIPYVTELEGDVNGMKFTIHGKGTGDATVGKVKAKYICTTGDVPVPWATLVSTLSYGVQCFAKYPSHIKDFFKSCMPEGYVQERTITFEGDGVFKTRAEVTFEDGSVYNRVKLTGQGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 36 - protein, 233 aa, Escherichia coli
MSSGTKLFEKEIPYITELEGDVNGMKFTIHGKGTGDATTGTIKAQYICTTGDLPVPWATLVSTLSYGVQCFAKYPPHIKDFYKSCMPEGYVQERTITFEGDGVFKTRAEVTFENGSVYNRVTLNGEGFKKDGHILRKNVAFQCPPDMLYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 37 - protein, 233 aa, Escherichia coli
MSSGAKLFEKKIPYITELEGDVNGMKFTIHGKGTGDATTGKIKAQFICTTGDVPVPWATLVSTLSYGVQCFAKYPSELKDFFKSCMPEGYVQERTITFEGDGVFRTRAEVTFENGSVYNRVTLTGEGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 38 - protein, 233 aa, Escherichia coli
MSSGAKLFTKKIPYVTELEGDVNGMKFTIHGKGTGDASTGTIDAQFICTTGDLPVPWATLVSTLSYGVQCFAKYPPELKDFFKSCMPEGYVQERTITFEGDGVFKTRAEVTFENGSVYNRVKLNGQGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 39 - protein, 233 aa, Escherichia coli
MSSGTKLFTNEIPYITELEGDVNGMKFTIHGKGTGDASTGKIKAQYICTTGDVPVPWATLVSTLSYGVQCFAKYPSHLKDFFKSCMPEGYVQERTITFEGDGVFKTRAEVTFENGSVYNRVTLNGEGFKKDGHILRKNVAFQCPPDILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 40 - protein, 233 aa, Escherichia coli; identical to SEQ ID NO: 14

SEQ ID NO: 41 - protein, 225 aa, Escherichia coli
MSSGAKLFTKEIPYVTELEGDVNGMKFTIHGKGTGDATTGTVKAKYICTTGDLPVPWATLVSTLSYGVQCFAKYGSCMPEGYVQERTITFEGDGVFRTRAEVTFENGSVYNRVKLNGQGFKKDGHILRKNVAFQCPPDILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 42 - protein, 233 aa, Escherichia coli
MSSGTKLFEKKIPYITELEGDVNGMKFTIHGKGTGDATTGTIKAQYICTTGDVPVPWATLVSTLSYGVQCFAKYPSHIKDFFKSCMPEGYVQERTITFEGDGVFKTRAEVTFENGSVYNRVTLTGQGFKKDGHILRKNVAFQCPPDMLYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 43 - protein, 233 aa, Escherichia coli
MSSGTLLFTNEIPYITELEGDVNGMKFTIHGKGTGDASVGKVKAKFICTTGDLPVPWATLVSTLSYGVQCFAKYPSEIKDFYKSCMPEGYVQERTITFEGDGVFKTRAEVTFENGSVYNRVTLTGEGFKKDGHILRKNVAFQCSPDILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 44 - protein, 233 aa, Escherichia coli
MSSGAKLFTNKIPYITELEGDVNGMKFTIHGKGTGDASVGKIKAKYICTTGDLPVPWATLVSTLSYGVQCFAKYPPEIKDFYKSCMPEGYVQERTITFEGDGVFKTRAEVTFENGSVYNRVTLNGQGFKKDGHILRKNVAFQCPPDIVYILPDTVNNGIRVEFNQAYDIEGVTEKLVTKCSQMNRPLAGSAAVHIPRYHHLSKHTKLSKDRGERRDHMCLVEVVKAVDLDTYQ

SEQ ID NO: 45 - protein, 236 aa, Escherichia coli; identical to SEQ ID NO: 12

SEQ ID NO: 46 - protein, 232 aa, Escherichia coli
MASKISDNVRIKLYMEGTVNGYHFKCEGEGDGNPFEGTQNMRIRVTEGAPLPFSFDILTPNCQYGSVAITKYTSGIPDYFKQSFPEGFTWERTTIYEDGAYLTTQQETKLDGNCLVYNIKILGCNFPPSGPVMQKKTQGWEPCCEMRYTRDGVLCGQTLMALKCADGNHLTCHLRTTYRSKKAAKALQMPPFHFSDHRPEIVKVSENGTLFEQHESSVARYCQTCPSKLGHN

SEQ ID NO: 47 - protein, 233 aa, Escherichia coli
MSSGTKLFEKKIPYVTELEGDVNGMKFTIHGKGTGDATVGTIKAQFICTTGDLPVPWATLVSTLSYGVQCFAKYPPHLKDFYKSCMPEGYVQERTITFEGDGVFKTRAEVTFENGSVYNRVTLTGQGFKKDGHILRKNVAFQCPPSMVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 48 - protein, 233 aa, Escherichia coli
MSSGALLFTKEIPYITELEGDVNGMKFTIHGKGTGDATVGKIDAKFICTTGDVPVPWATLVSTLSYGVQCFAKYPSELKDFYKSCMPEGYVQERTITFEGDGVFKTRAEVTFENGSVYNRVTLTGQGFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 49 - protein, 233 aa, Escherichia coli
MSSGALLFTKEIPYVTELEGDVNGMKFTIHGKGTGDATVGTIKAQFICTTGDLPVPWATLVSTLSYGVQCFAKYPPHLKDFYKSAMPEGYVQERTITFEGDGVFKTRAEVTFENGSVYNRVKLTGQGFKKDGHILRKNVAFQCPPSMLYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 50 - protein, 233 aa, Escherichia coli
MSSGAKLFEKEIPYVTELEGDVNGMKFTIHGKGTGDATTGTIKAQYICTTGDVPVPWATLVSTLSYGVQCFAKYGPHLKDFYKSCMPEGYVQERTITFEGDGVFKTRAEVTFENGSVYNRVTLNGQGFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 51 - protein, 233 aa, Escherichia coli
MSSGTKLFTKEIPYVTELEGDVNGMKFTIHGKGTGDASTGTVKAKYICTTGDLPVPWATLVSTLSYGVQCFAKYPPHIKDFYKSCMPEGYVQERTITFEGDGVFKTRAEVTFENGSVYNRVKLNGETFKKDGHILRKNVAFQCPPSMVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 52 - protein, 233 aa, Escherichia coli
MSSGAKLFEKKIPYVTELEGDVNGMKFTIHGKGTGDATVGTVDAQFICTTGDVPVPWATLVSTLSYGVQCFAKYPPHIKDFFKSAMPEGYVQERTITFEGDGVFKTRAEVTFENGSVYNRVTLNGQGFKKDGHILRKNVAFQCPPSIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 53 - protein, 233 aa, Escherichia coli
MSSGAKLFTKKIPYITELEGDVNGMKFTIHGKGTGDATTGTIKAKFICTTGDVPVPWATLVSTLSYGVQCFAKYPSEIKDFYKSCMPEGYVQERTITFEGDGVFKTRAEVTFENGSVYNRVKLTGQGFKKDGHILRKNVAFQCPPSMLYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 54 - protein, 233 aa, Escherichia coli
MSSGAKLFTKEIPYITELEGDVNGMKFTIHGKGTGDATVGKIDAQFICTTGDVPVPWATLVSTLSYGVQCFAKYPSEIKDFYKSCMPEGYVQERTITFEGDGVFKTRAEVTFENGSVYNRVKLNGEGFKKDGHILRKNVAFQCPPSIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 55 - protein, 233 aa, Escherichia coli
MSSGTKLFTNEIPYITELEGDVNGMKFTIHGKGTGDATTGKIDAKYICTTGDVPVPWATLVSTLSYGVQCFAKYPSHLKDFFKSAMPEGYVQERTITFEGDGVFKTRAEVTFENGSVYNRVTLTGQGFKKDGHILRKNVAFQCPPSIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 56 - protein, 226 aa, Escherichia coli
MSLSKQVLPRDVKMRYHMDGCVNGHRFIIEGEGTGKPYEGKKILELRVTKGGPLPFAFDILSSVFTYGNRCFCEYPEDMPDYFKQSLPEGHSWERTLMFEDGGCGTASAHISLDKNCFVHKSTFHGVNFPANGPVMQKKTMNWEPSSELITPCDGILKGDVTMFLLQEGGHRLKCQFTTSYKAHKAVKIPPNHIIEHVLVKKEVADGFQIQEHAVAKHFTVDVKET

SEQ ID NO: 57 - protein, 236 aa, Escherichia coli; identical to SEQ ID NO: 27

SEQ ID NO: 58 - protein, 233 aa, Escherichia coli
MSSGTKLFTNKIPYVTELEGDVNGMKFTIHGKGTGDASTGTIKAKYICTTGDVPVPWATLVSTLSYGVQCFAKYGSEIKDFYKSAMPEGYVQERTITFEGDGVFKTRAEVTFENGSVYNRVKLTGQGFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 59 - protein, 233 aa, Escherichia coli
MSSGTKLFTKEIPYVTELEGDVNGMKFTIHGKGTGDASVGKVKAKFICTTGDLPVPWATLVSTLSYGVQCFAKYPPHIKDFFKSCMPEGYVQERTITFEGDGVFKTRAEVTFENGSVYNRVTLNGETFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 60 - protein, 233 aa, Escherichia coli
MSSGTKLFTNKIPYITELEGDVNGMKFTIHGKGTGDASTGTIDAKFICTTGDVPVPWATLVSTLSYGVQCFAKYPPHLKDFYKSCMPEGYVQERTITFEGDGVFKTRAEVTFENGSVYNRVKLTGEGFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 61 - protein, 233 aa, Escherichia coli
MSSGAKLFENEIPYVTELEGDVNGMKFTIHGKGTGDASVGTIKAQFICTTGDLPVPWATLVSTLSYGVQCFAKYPPHIKDFYKSCMPEGYVQERTITFEGDGVFKTRAEVTFENGSVYNRVKLTGQGFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 62 - protein, 233 aa, Escherichia coli
MSSGTLLFTNEIPYITELEGDVNGMKFTIHGKGTGDATVGTIKAKYICTTGDVPVPWATLVSTLSYGVQCFAKYPPEIKDFFKSCMPEGYVQERTITFEGDGVFKTRAEVTFENGSVYNRVTLTGEGFKKDGHILRKNVAFQCPPSMVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 63 - protein, 233 aa, Escherichia coli
MSSGTLLFTKEIPYVTELEGDVNGMKFTIHGKGTGDASVGKVKAKFICTTGDVPVPWATLVSTLSYGVQCFAKYGPELKDFYKSCMPEGYVQERTITFEGDGVFKTRAEVTFENGSVYNRVTLNGEGFKKDGHILRKNVAFQCPPSMLYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 64 - protein, 233 aa, Escherichia coli
MSSGAKLFEKEIPYVTELEGDVNGMKFTIHGKGTGDASTGTIKAQYICTTGDVPVPWATLVSTLSYGVQCFAKYPPELKDFYKSAMPEGYVQERTITFEGDGVFKTRAEVTFENGSVYNRVKLTGEGFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 65 - protein, 233 aa, Escherichia coli
MSSGTLLFTKEIPYITELEGDVNGMKFTIHGKGTGDATVGTIKAKYICTTGDLPVPWATLVSTLSYGVQCFAKYPPEIKDFYKSAMPEGYVQERTITFEGDGVFKTRAEVTFENGSVYNRVKLNGEGFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 66 - protein, 221 aa, Escherichia coli
MSLSKQVLPRDVKMRYHMDGCVNGHQFIIEGEGTGKPYEGKKTLKLRVTKGGPLPFAFDILSAVFAYGNRCFCDYPEDMPDYFKQSLPEGHSWERTMMYEDGGCGTSSAHIRLEKNCFIHNSTFHGVNFPANGPVMQKKTLNWEPSSELITAGDGILKGDVTMFLMLEGGHRLKCQFTTSYKAKKAVKMPPNHIIEHRLVRKEVADAVQIQEHAVAKHFIV

SEQ ID NO: 67 - protein, 233 aa, Escherichia coli
MSSGTLLFTKKIPYVTELEGDVNGMKFTIHGKGTGDATTGTIDAKYICTTGDVPVPWATLVSTLSYGVQCFAKYPSHIKDFYKSCMPEGYVQERTITFEGDGVFKTRAEVTFENGSVYNRVTLNGQGFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 68 - protein, 232 aa, Escherichia coli
MSSGTLLFEKKIPYVTELEGDVNGMKFTIHGKGTGDASTGTVKAQYICTTGDPVPWATLVSTLSYGVQCFAKYPPHLKDFFKSCMPEGYVQERTITFEGDGVFKTRAEVTFENGSVYNRVKLTGEGFKKDGHILRKNVAFQCPPSIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 69 - protein, 233 aa, Escherichia coli
MSSGTLLFTKEIPYITELEGDVNGMKFTIHGKGTGDATTGKIDAKYICTTGDLPVPWATLVSTLSYGVQCFAKYPSHLKDFYKSCMPEGYVQERTITFEGDGVFKTRAEVTFENGSVYNRVTLTGEGFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 70 - protein, 139 aa, Escherichia coli
MMRRHYRDLIRNTPMPDTPQDIADLRALLDEDEAEMSVVFSDPSQPDNPMIYVSDAFLVQTGYTLEEVLGRNARFLQGPDTNPHAVEAIRQGLKAETRFTIDILNYRKDGSAFVNRLRIRPIYDPEGNLMFFAGAQNPV

SEQ ID NO: 71 - protein, 137 aa, Escherichia coli
MASFQSFGIPGQLEVIKKALDHVRVGVVITDPALEDNPIVYVNQGFVQMTGYETEEILGKNARFLQGKHTDPAEVDNIRTALQNKEPVTVQIQNYKKDGTMFWNELNIDPMEIEDKTYFVGIQNDITKQKEYEKLLE

SEQ ID NO: 72 - protein, 123 aa, Escherichia coli
MKHHHHHHGSPEFIEKNFVISDPRLPDNPIIFASDSFLELTEYSREEILGRNARFLQGPETDQATVQKIRDAIRDQREITVQLINYTKSGKKFWNLFHLQPMRDQKGELQYFIGVQLDGSDHV

SEQ ID NO: 73 - protein, 121 aa, Escherichia coli
MKHHHHHHGSPEFIEKNFVITDPRLPDNPIIFASDGFLELTEYSREEILGRNARFLQGPETDQATVQKIRDAIRDQRETTVQLINYTKSGKKFWNLLHLQPVRDQKGELQYFIGVQLDGSD

SEQ ID NO: 74 - protein, 142 aa, Escherichia coli
MINAQLLQSMVDASNDGIVVAEKEGDDTILIYVNAAFEYLTGYSRDEILYQDARFLQGDDRDQLGRARIRKAMAEGRPCREVLRNYRKDGSAFWNELSITPVKSDFDQRTYFIGIQKDVSRQVELERELAELRARPKPDERA

SEQ ID NO: 75 - protein, 236 aa, Escherichia coli
MTALTEGAKLFEKEIPYITELEGDVEGMKFIIKGEGTGDASVGKVDAQFICTTGDVPVPWSTLVTTLTYGAQCFAKYPRHIADFFKSCMPEGYVQERTITFEGDGVFKTRAEVTFENGSVYNRVKLNGQGFKKDGHVLGKNLEFNFTPHCLYIWGDQANHGLKSAFKVMHEITGSKEDFIVADHTQMNTPIGGGPVHVPEYHHITYHVTLSKDVTDHRDHLNIVEVIKAVDLETYR

SEQ ID NO: 76 - protein, 236 aa, Escherichia coli
MTALTEGAKLFEKEIPYITELEGDVEGMKFIIKGEGTGDASVGKIDAQFICTTGDVPVPWSTLVTTLTYGAQCFAKYPRHIADFFKSCMPEGYVQERTITFEGDGVFKTRAEVTFENGSVYNRVKLNGQGFKKDGHVLGKNLEFNFTPHCLYIWGDQANHGLKSAFKIMHEITGSKEDFIVADHTQMNTPIGGGPVHVPEYHHITYHVTLSKDVTDHRDHLNIVEVIKAVDLETYR

SEQ ID NO: 77 - protein, 236 aa, Escherichia coli
MTALTEGAKLFEKEIPYITELEGDVEGMKFIIKGEGTGDASVGKVDAQFICTTGDVPVPWSTLVTTLTYGAQCFAKYPRHIADFFKSCMPEGYVQERTITFEGDGVFKTRAEVTFENGSVYNRVKLNGQGFKKDGHVLGKNLEFNFTPHCLYIWGDQANHGLKSAFKIMHEITGSKEDFIVADHTQMNTPIGGGPVHVPEYHHITYHVTLSKDVTDHRDHLNIVEVHKAVDLETYR

SEQ ID NO: 78 - protein, 236 aa, Escherichia coli
MTALTEGAKLFEKEIPYITELEGDVEGMKFIIKGEGTGDASVGKVDAQFICTTGDVPVPWSTLVTTLTYGAQCFAKYPRHIADFFKSCMPEGYVQERTITFEGDGVFKTRAEVTFENGSVYNRVKLNGQGFKKDGHVLGKNLEFNFTPSCLYIWGDQANHGLKSAFKIMHEITGSKEDFIVADHTQMNTPIGGGPVHVPEYHHITYHVTLSKDVTDHRDHLNIVEVIKAVDLETYR

SEQ ID NO: 79 - protein, 236 aa, Escherichia coli; identical to SEQ ID NO: 78

SEQ ID NO: 80 - protein, 236 aa, Escherichia coli
MTALTEGAKLFEKEIPYITELEGDVEGMKFIIKGEGTGDASVGKVDAQFICTTGDVPVPWSTLVTTLTYGAQCFAKYPRHIADFFKSCMPEGYVQERTITFEGDGVFKTRAEVTFENGSVYNRVKLNGQGFKKDGHVLGKNLEFNFTPSCLYIWGDQANHGLKSAFKIMHEITGSKEDFIVADHTQMNTPIGGGPVHVPEYHHITYHVTLSKDVTDHRDHLNIVEVLKAVDLETYR

SEQ ID NO: 81 - protein, 235 aa, Escherichia coli; identical to SEQ ID NO: 29

SEQ ID NO: 82 - protein, 236 aa, Escherichia coli; identical to SEQ ID NO: 11

SEQ ID NO: 83 - protein, 236 aa, Escherichia coli
MTALTEGAKLFEKEIPYITELEGDVEGMKFIIKGEGTGDASVGKVDAQFICTTGDVPVPWSTLVTTLTYGAQCFAKYPRHIADFFKSCMPEGYVQERTITFEGDGVFKTRAEVTFENGSVYNRVKLNGQGFKKDGHVLGKNLEFNFTPHCLYIWGDQANHGLKSAFKIMHEITGSKEDFIVADHTQMNTPIGGGPVHVPEYHHITYHVTLSKDVTDHRDHLNIVEVVKAVDLETYR

SEQ ID NO: 84 - protein, 236 aa, Escherichia coli
MTALTEGAKLFEKEIPYITELEGDVEGMKFIIKGEGTGDASVGKVDAQFICTTGDVPVPWSTLVTTLTYGAQCYAKYPRHIADFFKSCMPEGYVQERTITFEGDGVFKTRAEVTFENGSVYNRVKLNGQGFKKDGHVLGKNLEFNFTPHCLYIWGDQANHGLKSAFKIMHEITGSKEDFIVADHTQMNTPIGGGPVHVPEYHHITYHVTLSKDVTDHRDHLNIVEVQKAVDLETYR

SEQ ID NO: 85 - protein, 228 aa, Escherichia coli; identical to SEQ ID NO: 5

SEQ ID NO: 86 - protein, 228 aa, Escherichia coli; identical to SEQ ID NO: 6

SEQ ID NO: 87 - protein, 226 aa, Escherichia coli
MSLSKQVLPRDVRMRFHMDGCVNGHSFTIEGEGTGKPYEGKKTLELRVTKGGPLPFAFDILSSVFTYGNRCFCDYPEDMPDYFKQSLPEGYSWERTLMFEDGGCGTASAHIRLEKDCFIHQSTFLGVNFPANGPVMQKKTLNWEPSSELITACDGILKGDVTMFLLLEGGHRLKCQFTTSYKAHKAVKMPPNHIIEHVLVKKEVADGFQIQEHAVAKHFTVDVKET

SEQ ID NO: 88 - protein, 226 aa, Escherichia coli
MSLSKQVLPRDVRMRFHMDGCVNGHQFTIEGEGAGKPYEGKKTLKLRVTKGGPLPFAFDILSATFTYGNRCFCDYPEDMPDYFKQSLPEGYSWERTLMFEDGGCGTASAHISLEKDCFIHNSTFHGVNFPANGPVMQKKTLNWEPSSELITACDGILKGDVTMFLLLEGGHRLKCQFTTSYKAHKAVKMPPNHIIEHVLVKKEVADGFQIQEHAVAKHFTVDVKET

SEQ ID NO: 89 - protein, 226 aa, Escherichia coli
MSLSKQVLPRDVRMRFHMDGCVNGHQFIIEGEGTGKPYEGKKILKLRVTKGGPLPFAFDILSSVFTYGNRCFCDYPEDMPDYFKQSLPEGYSWERTLMFEDGGCGTASAHISLDKNCFIHNSTFHGVNFPADGPVMQKKTLNWEPSSELITACDGILKGDVTMFLLLEGGHRLKCQFTTSYKAHKAVKIPPNHIIEHVLVKKEVADGFQIQEHAVAKHFTVDVKET

SEQ ID NO: 90 - protein, 226 aa, Escherichia coli
MSLSKQVLPRDVRMRFHMDGCVNGHQFTIEGEGAGKPYEGKKILKLRVTKGGPLPFAFDILSSVFTYGNRCFCEYPEDMPDYFKQSLPEGYSWERTLMFEDGGCGVASAHIRLEKDCFIHNSTFLGVNFPANGPVMQKKTLNWEPSSELITACDGILKGDVLMFLLLEGGHRLKCQFTTSYKASKAVKIPPSHIIEHVLVKKEVADGFQIQEHAVAKHFTVDVKET

SEQ ID NO: 91 - protein, 226 aa, Escherichia coli
MSLSKQVLPRDVRMRFHMDGCVNGHQFTIEGEGAGKPYEGKKILKLRVTKGGPLPFAFDILSSVFTYGNRCFCEYPEDMPDYFKQSLPEGYSWERTLMFEDGGCGCASAHIRLEKDCFIHNSTFLGVNFPANGPVMQKKTLNWEPSSELITACDGILKGDVAMFLLLEGGHRLKCQFTTSYKASKAVKIPPCHIIEHVLVKKEVADGFQIQEHAVAKHFTVDVKET

SEQ ID NO: 92 - protein, 226 aa, Escherichia coli; identical to SEQ ID NO: 88

SEQ ID NO: 93 - protein, 226 aa, Escherichia coli
MSLSKQVLPRDVRMRFHMDGCVNGHQFTIEGEGAGKPYEGKKILELRVTKGGPLPFAFDILSSTFTYGNRCFCDYPEEMPDYFKQSLPEGYSWERTLMFEDGGCGTASAHIRLEKDCFVHQSTFHGVNFPANGPVMQKKTLNWEPSSELITACDGILKGDVTMFLLLEGGHRLKCQFTTSYKAHKAVKIPPNHIIEHVLVKKEVADGFQIQEHAVAKHFTVDVKET

SEQ ID NO: 94 - protein, 226 aa, Escherichia coli
MSLSKQVLPRDVRMRFHMDGCVNGHSFIIEGEGTGKPDEGKKILKLRVTKGGPLPFAFDILSATFTYGNRCFCEYPEDMPDYFKQSLPEGHSWERTLMFEDGGCGTASAHISLEKDCFIHKSTFHGVNFPANGPVMQKKTLNWEPSSELITACDGILKGDVTMFLLLEGGHRLKCQFTTSYKAHKAVKIPPNHIIEHVLVKKEVADGFQIQEHAVAKHFTVDVKET

SEQ ID NO: 95 - protein, 226 aa, Escherichia coli
MSLSKQVLPHDVKMRYHMDGCVNGHSFTIEGEGAGKPYEGKKILELRVTKGGPLPFAFDILSSVFTYGNRCFCEYPEDMPDYFKQSLPEGHSWERTLMFEDGGCGTASAHISLDKNCFVHKSTFHGVNFPANGPVMQKKAMNWEPSSELITACDGILKGDVTMFLLLEGGHRLKCQFTTSYKAHKAVKMPPNHIIEHVLVKKEVADGFQIQEHAVAKHFTVDVKET

SEQ ID NO: 96 - protein, 226 aa, Escherichia coli
MSLSKQVLPRDVRMRFHMDGCVNGHQFIIEGEGAGKPDEGKKILKLRVTKGGPLPFAFDILSSTFTYGNRCFCDYPEDMPDYFKQSLPEGHSWERTLMFEDGGCGTASAHISLDKDCFVHQSTFLGVNFPANGPVMQKKTLNWEPSSELITACDGILKGDVTMFLLLEGGHRLKCQFTTSYKASKAVKMPPNHIIEHVLVKKEVADGFQIQEHAVAKHFTVDVKET

SEQ ID NO: 97 - protein, 226 aa, Escherichia coli
MSLSKQVLPRDVRMRFHMDGCVNGHSFTIEGEGAGKPDEGKKTLKLRVTKGGPLPFAFDILSATFTYGNRCFCDYPEDMPDYFKQSLPEGHSWERTLMFEDGGCGTASAHISLEKNCFIHKSTFHGVNFPANGPVMQKKTLNWEPSSELITACDGILKGDVTMFLLLEGGHRLKCQFTTSYKASKAVKIPPNHIIEHVLVKKEVADGFQIQEHAVAKHFTVDVKET

SEQ ID NO: 98 - protein, 226 aa, Escherichia coli
MSLSKQVLPRDVKMRYHMDGCVNGHQFIIEGEGTGKPDEGKKILELRVTKGGPLPFAFDILSATFTYGNRCFCEYPEDMPDYFKQSLPEGHSWERTMMYEDGACSTASAHIRLEKDCFVHNSTFHGVNFPANGPVMQKKTLNWEPSSELITAGDGILKGDVTMFLMLEGGHRLKCQFTTSYKAKKAVKMPPNHIIEHVLVKKEVADGFQIQEHAVAKHFTVDVKET

SEQ ID NO: 99 - protein, 226 aa, Escherichia coli
MSLSKQVLPHDVKMRYHMDGCVNGHSFTIEGEGAGKPDEGKKTLKLRVTKGGPLPFAFDILSATFTYGNRCFCDYPEEMPDYFKQSLPEGHSWERTLMFEDGGCSTASAHISLEKNCFVHQSTFHGVNFPANGPVMQKKTLNWEPSSELITPGDGILKGDVTMFLLLEGGHRLKCQFTTSYKAKKAVKMPPNHIIEHVLVKKEVADGFQIQEHAVAKHFTVDVKET

SEQ ID NO: 100 - protein, 24 aa, Foot-and-mouth disease virus
APVKQLLNFDLLKLAGDVESNPGP

SEQ ID NO: 101 - protein, 18 aa, Thosea asigna virus
EGRGSLLTCGDVEENPGP

SEQ ID NO: 102 - protein, 19 aa, Polytropic virus
ATNFSLLKQAGDVEENPGP

SEQ ID NO: 103 - protein, 19 aa, Foot-and-mouth disease virus
LLNFDLLKLAGDVESNPGP

SEQ ID NO: 104 - protein, 19 aa, Encephalomyocarditis virus
TLNFDLLKLAGDVESNPGP

SEQ ID NO: 105 - protein, 25 aa, Encephalomyocarditis virus
GIFNAHYAGYFADLLIHDIETNPGP

SEQ ID NO: 106 - protein, 25 aa, Encephalomyocarditis virus
KAVRGYHADYYKQRLIHDVEMNPGP

SEQ ID NO: 107 - protein, 24 aa, Foot-and-mouth disease virus
APGKQLLNFDLLKLAGDVESNPGP

SEQ ID NO: 108 - protein, 24 aa, Foot-and-mouth disease virus
APVKQLTNFDLLKLAGDVESNPGP

SEQ ID NO: 109 - protein, 24 aa, Equine rhinitis virus
APVKQLTNFDLLKLAGDVESNPGP

SEQ ID NO: 110 - protein, 25 aa, Equine rhinitis virus
TILSEGATNFSLLKLAGDVELNPGP

SEQ ID NO: 111 - protein, 27 aa, Punta Toro virus
VMAFQGPGATNFSLLKQAGDVEENPGP

SEQ ID NO: 112 - protein, 20 aa, Cottontail Rabbit Herpesvirus
FLRKRTQLLMSGDVESNPGP

SEQ ID NO: 113 - protein, 20 aa, Drosophila C virus
EAARQMLLLLSGDVETNPGP

SEQ ID NO: 114 - protein, 20 aa, Acute bee paralysis virus
GSWTDILLLLSGDVETNPGP

SEQ ID NO: 115 - protein, 20 aa, Influenza A virus
TRAEIEDELIRAGIESNPGP

SEQ ID NO: 116 - protein, 20 aa, Tomato aspermy virus
RAEGRGSLLTCGDVEENPGP

SEQ ID NO: 117 - protein, 20 aa, Trypanosoma brucei
SSIIRTKMLVSGDVEENPGP

SEQ ID NO: 118 - protein, 20 aa, Rotavirus B37
AKFQIDKILISGDVELNPGP

SEQ ID NO: 119 - protein, 20 aa, Rotavirus B37
SKFQIDKILISGDIELNPGP

SEQ ID NO: 120 - protein, 25 aa, Encephalomyocarditis virus
GIFNAHYAGYFADLLIHDIETNPGP

SEQ ID NO: 121 - protein, 25 aa, Encephalomyocarditis virus
RIFNAHYAGYFADLLIHDIETNPGP

SEQ ID NO: 122 - protein, 25 aa, Mengo virus
HVFETHYAGYFSDLLIHDVETNPGP

SEQ ID NO: 123 - protein, 25 aa, Encephalomyocarditis virus
RAVRAYHADYYKQRLIHDVEMNPGP

SEQ ID NO: 124 - protein, 25 aa, Encephalomyocarditis virus
KAVRGYHADYYRQRLIHDVETNPGP

SEQ ID NO: 125 - protein, 25 aa, Encephalomyocarditis virus
KHVREYHAAYYKQRLMHDVETNPGP

SEQ ID NO: 126 - protein, 26 aa, Ljungan virus
MHSDEMDFAGGKFLNQCGDVETNPGP

SEQ ID NO: 127 - protein, 26 aa, Ljungan virus
MHNDEMDYSGGKFLNQCGDVESNPGP

SEQ ID NO: 128 - protein, 26 aa, Ljungan virus
MHSDEMDFAGGKFLNQCGDVETNPGP

SEQ ID NO: 129 - protein, 26 aa, Ljungan virus
YHDKDMDYAGGKFLNQCGDVETNPGP

SEQ ID NO: 130 - protein, 20 aa, Acute bee paralysis virus
GSWTDILLLLSGDVETNPGP

SEQ ID NO: 131 - protein, 20 aa, Acute bee paralysis virus
GSWTDILLLWSGDVETNPGP

SEQ ID NO: 132 - protein, 24 aa, Foot-and-mouth disease virus
APAKQLLNFDLLKLAGDVESNPGP

SEQ ID NO: 133 - protein, 24 aa, Foot-and-mouth disease virus
APAKQLLNFDLLKLAGDVESNPGP

SEQ ID NO: 134 - protein, 24 aa, Foot-and-mouth disease virus
APVKQLLNFDLLKLAGDMESNPGP

SEQ ID NO: 135 - protein, 24 aa, Foot-and-mouth disease virus
APAKQLLNFDLLKLAGDVESNPGP

SEQ ID NO: 136 - protein, 24 aa, Foot-and-mouth disease virus
APVKQLLSFDLLKLAGDVESNPGP

SEQ ID NO: 137 - protein, 24 aa, Foot-and-mouth disease virus
KPDKQMCNFDLLKLAGDVESNPGP

SEQ ID NO: 138 - protein, 24 aa, Foot-and-mouth disease virus
GVAKQLLNFDLLKLAGDVESNPGP

SEQ ID NO: 139 - protein, 25 aa, retroviral provirus
NLLSQGATNFDLLKLAGDVESNPGP

SEQ ID NO: 140 - protein, 27 aa, Polytropic virus
TMMLQGPGATNFSLLKQAGDVEENPGP

SEQ ID NO: 141 - protein, 27 aa, Polytropic virus
TMSFQGPGASSFSLLKQAGDVEENPGP

SEQ ID NO: 142 - protein, 27 aa, Polytropic virus
TMMLQGPGASNFSLLKQAGDVEENPGP

SEQ ID NO: 143 - protein, 27 aa, Polytropic virus
TMLFQGPGAANFSLLRQAGDVEENPGP

SEQ ID NO: 144 - protein, 27 aa, Polytropic virus
TMSFQGPGATNFSLLKQAGDVEENPGP

SEQ ID NO: 145 - protein, 27 aa, Polytropic virus
VVSFQGPGATNFSLLKQAGDVEENPGP

SEQ ID NO: 146 - protein, 27 aa, Polytropic virus
TMSLQGPGATNFSLLKQAGDIEENPGP

SEQ ID NO: 147 - protein, 27 aa, Polytropic virus
TMAFQGPGATNFSLLKQAGDVEENPGP

SEQ ID NO: 148 - protein, 27 aa, Polytropic virus
TLSFQGPGATNFSLLKQAGDVEENPGP

SEQ ID NO: 149 - protein, 27 aa, Polytropic virus
RMSFQGPGATNFSLLKRAGDVEENPGP

SEQ ID NO: 150 - protein, 20 aa, Polytropic virus
GTWESVLNLLAGDIELNPGP

SEQ ID NO: 151 - protein, 20 aa, Picorna-like virus
AQGWVPDLTVDGDVESNPGP

SEQ ID NO: 152 - protein, 20 aa, Picorna-like virus
IGGGQKDLTQDGDIESNPGP

SEQ ID NO: 153 - protein, 20 aa, Picorna-like virus
AQGWAPDLTQDGDVESNPGP

SEQ ID NO: 154 - protein, 20 aa, Picorna-like virus
IGGGQRDLTQDGDIESNPGP

SEQ ID NO: 155 - protein, 19 aa, Providence virus
VGDRGSLLTCGDVESNPGP

SEQ ID NO: 156 - protein, 19 aa, Providence virus
SGGRGSLLTAGDVEKNPGP

SEQ ID NO: 157 - protein, 19 aa, Providence virus
GDPIEDLTDDGDIEKNPGP

SEQ ID NO: 158 - protein, 20 aa, Rotavirus B37
SKFQIDRILISGDIELNPGP

SEQ ID NO: 159 - protein, 20 aa, Bombyx mori
FRSNYDLLKLCGDIESNPGP

SEQ ID NO: 160 - DNA, 711 bp, Pichia pastoris
atgactgccctgactgaaggcgcaaaactgttcgagaaagagattccttatatcactgaattggaaggtgacgttgagggtatgaaattcatcatcaaaggtgaaggtacaggagatgcttcagttggaaaggtggatgctcagtttatctgcacaacgggagacgtcccagtgccatggagcaccttggttaccacactaacttatggcgcacaatgttttgccaaatacccaagacatatcgcagactttttcaaatcctgtatgccggaaggttacgttcaagagcgtacaattacatttgagggtgatggtgttttcaagacaagagctgaggtgactttcgaaaatggaagtgtctataacagagtgaaactgaatggtcaaggttttaagaaagatggacatgtattgggaaagaatttggagttcaactttactccacactgtctttacatctggggtgaccaagctaatcatggattgaaatccgcttttaagataatgcacgaaattacaggttcgaaggaagatttcattgtggcagaccatactcagatgaacacccctattggcggtggtcctgttcacgttcccgaataccatcacatcacgtaccatgtaactctttctaaggacgttaccgatcaccgtgaccatctcaatatagtcgaggtcattaaggctgttgacttagagacttataggtga

SEQ ID NO: 161 - protein, 236 aa, Pichia pastoris; identical to SEQ ID NO: 11

SEQ ID NO: 162 - DNA, 711 bp, Pichia pastoris
atgacggctttgacagaaggcgcaaaactttttgagaaggaaattccttacattacagaattagagggagacgttgagggaatgaaattcatcatcaagggtgagggtactggtgacgcttcagttggtaaagtagacgcacaattcatctgtactactggtgatgtgcctgttccctggtccacacttgttacaaccctgacctatggtgctcaatgtttcgccaaatatccaaggcacatcgctgactttttcaagagttgcatgccggaaggttatgtgcaagagcgtaccattacatttgaaggtgacggtgtctttaagactcgtgctgaagtaacttttgaaaatggatccgtgtacaatagagtcaagttgaacggacaaggtttcaaaaaggatggtcatgtgctaggtaagaatctcgagtttaactttacacctcattgtttgtacatttggggagatcaggcaaatcacggcctgaaaagcgccttcaaaatcatgcatgagattactggatcgaaggaagatttcatagttgcagatcatacacagatgaataccccaattggtggaggtccagttcatgtgccagagtatcatcacatcacttaccacgtcactttgtctaaagacgttactgaccatagagatcacttaaacatagtcgaggttatcaaagctgtagatttggaaacgtacagatga

SEQ ID NO: 163 - protein, 236 aa, Pichia pastoris; identical to SEQ ID NO: 11

SEQ ID NO: 164 - DNA, 1677 bp, Pichia pastoris
atggtaagcaaatgcgaagaggacaatatggcaatcatcaaagagtttatgagattcaaggtccacatggaaggttctgtgaacggtcatgaatttgaaatcgaaggtgagggtgagggtagaccctatgaaggaacacaaacagctaaattgaaggtgacgaagggaggaccacttccattcgcatgggacattttgtcaccccaattcatgtacggctctaaggcctacgttaagcatcctgctgacattccagactacttaaaactgtcttttccagaaggattcaaatgggagcgtgtaatgaattttgaggatggaggtgttgttactgtgactcaagatagcagtttacaagatggtgagtttatctacaaagttaaactcagaggtacaaatttcccgtcggacggtcctgttatgcaaaagaaaaccatgggttgggaagcatcctccgaaaggatgtatcctgaggacggtgctcttaaaggtgagatcaaacagagattgaagttgaaagacggtggacattatgacgctgaggtgaaaactacctataaggctaaaaagcctgttcagctaccaggtgcatacaatgtcaacattaagttggatataacttcacacaacgaagattatacaattgtcgaacagtacgaaagagccgagggacgtcattccactggtggaatggatgagctgtataaagattacaaggatgatgacgataagggcgctggcactagtgagggcagaggaagtctgctaacatgcggtgacgtcgaggagaatcctggcccaatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagattaggaagaacaacaagagacgatctgataaatggaaattctgcctcctgtgctgatgttatatttatatatgcccgaggctctacagaaactggcaatttgggaactttgggcccatctattgcttctaaccttgaatctgcttttggtaaggatggagtttggattcagggcgtgggtggagcctatgctgccactttgggtgacaatgctttgccaagaggtacatcctcagccgctattcgtgagatgttaggtttatttcagcaggctaacactaagtgtcccgatgcaacattgattgcaggtggatattctcaaggtgccgccttggccgccgcttctattgaagaccttgatagtgcaataagggacaagattgcaggtacagttttgtttggttacaccaagaatctacaaaacagaggtcgaatccccaattacccagctgacagaacgaaggtcttttgtaatacaggcgaccttgtgtgtaccggatctttgatagtcgctgctccccatttggcttacggaccagatgctagaggtccagcacccgaattcttgattgagaaagtacgtgctgttagaggttcagcccatcatcatcatcaccattga

SEQ ID NO: 165 - protein, 558 aa, Pichia pastoris
MVSKCEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKDYKDDDDKGAGTSEGRGSLLTCGDVEENPGPMRFPSIFTAVLFAASSALAAPVNTTTEDETAQIPAEAVIGYSDLEGDFDVAVLPFSNSTNNGLLFINTTIASIAAKEEGVSLEKRLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSAHHHHHH

SEQ ID NO: 166 - DNA, 1680 bp, Pichia pastoris
atggtaagcaaatgcgaagaggacaatatggcaatcatcaaagagtttatgagattcaaggtccacatggaaggttctgtgaacggtcatgaatttgaaatcgaaggtgagggtgagggtagaccctatgaaggaacacaaacagctaaattgaaggtgacgaagggaggaccacttccattcgcatgggacattttgtcaccccaattcatgtacggctctaaggcctacgttaagcatcctgctgacattccagactacttaaaactgtcttttccagaaggattcaaatgggagcgtgtaatgaattttgaggatggaggtgttgttactgtgactcaagatagcagtttacaagatggtgagtttatctacaaagttaaactcagaggtacaaatttcccgtcggacggtcctgttatgcaaaagaaaaccatgggttgggaagcatcctccgaaaggatgtatcctgaggacggtgctcttaaaggtgagatcaaacagagattgaagttgaaagacggtggacattatgacgctgaggtgaaaactacctataaggctaaaaagcctgttcagctaccaggtgcatacaatgtcaacattaagttggatataacttcacacaacgaagattatacaattgtcgaacagtacgaaagagccgagggacgtcattccactggtggaatggatgagctgtataaagattacaaggatgatgacgataagggcgctggcactagttacgctggatattttgccgatttgctcatccatgacattgaaactaacccaggtcctatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagattaggaagaacaacaagagacgatctgataaatggaaattctgcctcctgtgctgatgttatatttatatatgcccgaggctctacagaaactggcaatttgggaactttgggcccatctattgcttctaaccttgaatctgcttttggtaaggatggagtttggattcagggcgtgggtggagcctatgctgccactttgggtgacaatgctttgccaagaggtacatcctcagccgctattcgtgagatgttaggtttatttcagcaggctaacactaagtgtcccgatgcaacattgattgcaggtggatattctcaaggtgccgccttggccgccgcttctattgaagaccttgatagtgcaataagggacaagattgcaggtacagttttgtttggttacaccaagaatctacaaaacagaggtcgaatccccaattacccagctgacagaacgaaggtcttttgtaatacaggcgaccttgtgtgtaccggatctttgatagtcgctgctccccatttggcttacggaccagatgctagaggtccagcacccgaattcttgattgagaaagtacgtgctgttagaggttcagcccatcatcatcatcaccattga

SEQ ID NO: 167 - protein, 559 aa, Pichia pastoris
MVSKCEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYKDYKDDDDKGAGTSYAGYFADLLIHDIETNPGPMRFPSIFTAVLFAASSALAAPVNTTTEDETAQIPAEAVIGYSDLEGDFDVAVLPFSNSTNNGLLFINTTIASIAAKEEGVSLEKRLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSAHHHHHH

SEQ ID NO: 168 - DNA, 876 bp, Pichia pastoris
atgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagattaggaagaacaacaagagacgatctgataaatggaaattctgcctcctgtgctgatgttatatttatatatgcccgaggctctacagaaactggcaatttgggaactttgggcccatctattgcttctaaccttgaatctgcttttggtaaggatggagtttggattcagggcgtgggtggagcctatgctgccactttgggtgacaatgctttgccaagaggtacatcctcagccgctattcgtgagatgttaggtttatttcagcaggctaacactaagtgtcccgatgcaacattgattgcaggtggatattctcaaggtgccgccttggccgccgcttctattgaagaccttgatagtgcaataagggacaagattgcaggtacagttttgtttggttacaccaagaatctacaaaacagaggtcgaatccccaattacccagctgacagaacgaaggtcttttgtaatacaggcgaccttgtgtgtaccggatctttgatagtcgctgctccccatttggcttacggaccagatgctagaggtccagcacccgaattcttgattgagaaagtacgtgctgttagaggttcagcccatcatcatcatcaccattga

SEQ ID NO: 169 - protein, 291 aa, Pichia pastoris
MRFPSIFTAVLFAASSALAAPVNTTTEDETAQIPAEAVIGYSDLEGDFDVAVLPFSNSTNNGLLFINTTIASIAAKEEGVSLEKRLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSAHHHHHH

SEQ ID NO: 170 - DNA, 687 bp, Pichia pastoris
atggcaagcttggtgaaaaaggacatgtgtataaagatgactatggagggaactgttaatggtcaccatttcaaatgtgttggtgagggagaaggaaagccctttgaaggaacacaaaacatgcgtattagagtaacagaaggtgcccctttgccttttgcttatgacatcttagcaccatgttgcatgtacggcagcaaaacattcatcaaacacacgtctggtattccagactactttaaacaatcattcccagagggatttacatgggagagaacccagatttttgaagatggcggttacctaaccatccaccaagatacttcccttcaaggtaataacttcatattcaaggtaaatgttatcggagctaatttcccggctaatggtccagtgatgcagaaaaagacggctggttgggagccatgcgtggagatgttgtatcctagagacggtgttttgtgtggacaaagtttgatggctctgaaatgtactgacggaaaccatcttacttctcatctgagaactacttacaggtcacgtaagccctctaatgctgtcaacatgcctgagtttcattttggtgatcataggattgaaattctgaaggcagaacagggtaaattctatgagcaatacgaatccgcagttgcaagatattgtgaagcagctccatcgaagttatga

SEQ ID NO: 171 - protein, 231 aa, Pichia pastoris; identical to SEQ ID NO: 10

SEQ ID NO: 172 - DNA, 687 bp, Pichia pastoris
atggccagcttagtgaaaaaggatatgtgcatcaaaatgacgatggaaggaactgtgaacggtcatcactttaagtgtgtcggtgaaggtgagggtaagcctttcgagggtacacagaatatgagaattagagtaactgaaggcgctcctttgccttttgcttttgatatcctgtccccatgttgcgcatatggaagtaagacgttcattaaacatgtttccggaataccagactacttcaaggagagctttccagaaggttttacttgggagcgtaccacaatttacgaagatggaggtgtccttactgcacatcaagacacttcactcgagggtaattgtttgatctacaaggttaaagtcctgggcactaacttccccgctgacggtccagttatgaaaaagatttctggtggttgggagccttgtgtggaaatgctatatcctagagacggtgttttgtgtggacaatctttgatggctttgaaatgtacagatggtaatcatttgacatcacaccttagaacaacctatcgtagtaggaaaccatctaatgccgttaacatgccagaatttcatttcggtgatcacagaatcgagatcttaaaagctgaacagggaaaattctacgaacaatacgagtccgcagtagctcgatattgcgaggctgcaccctcgaagctatga

SEQ ID NO: 173 - protein, 231 aa, Pichia pastoris; identical to SEQ ID NO: 4

SEQ ID NO: 174 - DNA, 687 bp, Pichia pastoris
atgtccaaaatctcagacaacgttcgtatcaaactatacatggagggtaccgtcaataatcatcactttatgtgtgaagctgaaggagagggaaaaccatacgagggtacacaggagatgaagattgaagttatagaaggtggtcctctgccattcgcttttcacattttgtcaacttcctgcatgtatggaagcaagacctttatcaaatatgtgtccggtatccctgactacttcaagcaatcgttcccagaaggatttacttgggagagaactacaacttatgaggatggaggctttctgacagcacatcaggacacatctttagatggtgactgtttggtctacaaagtaaagattttgggtaacaatttccctgcagatggtccagtgatgcaaaacaaggccgagaggtgggagcccgctactgaaatcttgtatgaagttgatggtgtgcttagaggtcaaacactaatggctcttaaatgtgctgatggaaatcatttgacctgtcatctcagaacgacttacagaagtaaaaagccagccagcgcattgaagatgcccggattccatttcggtgaccaccgtattgaaatcatggaagaggtagaaaaaggcaagtgttacaagcaatatgaggctgccgttgcaagatactgcgatgcagctccttctaaactgtga

SEQ ID NO: 175 - protein, 231 aa, Pichia pastoris; identical to SEQ ID NO: 7

SEQ ID NO: 176 - DNA, 687 bp, Pichia pastoris
atggcttcacttgtgaaaaaggatatgtgtattaagatgactatggagggtactgtaaacggttaccacttcaaatgtgtaggtgaaggagagggaaaaccatttgaaggtactcaaaacatgagaatccgtgtcacagagggcggtcctttaccatttgctttcgacattttggctccatgttgcatgtatggttctaagacttttatcaaacatgtttctggtattcccgactacttcaaagagagcttcccagaaggatttacctgggagaggacacagatattcgaagatggaggtgtcctgacagcccatcaagatacgtccttagaaggaaattgcttgatctacaaagttaaggtgctgggcaccaattttcctgccaatggtcccgttatgcaaaagaaaactgctggttgggaaccttgtgttgagatgctatatccaagagatggtgttttgtgtggacagtcacttatggctctgaagtgtacagatggtaaccatttgacttcccacttgcgtaccacttatagaagtagaaaaccttcgaatgcagtgaatatgccagagttccattttggtgaccacagaattgagatcctcaaggcagaacaaggaaaattctatgaacaatacgaaagcgcagtggctaggtactccgacgttcctgagaaggcaacatga

SEQ ID NO: 177 - protein, 228 aa, Pichia pastoris; identical to SEQ ID NO: 5

SEQ ID NO: 178 - DNA, 687 bp, Pichia pastoris
atggctagcttagtgaaaaaggatatgtgtattaagatgactatggagggcacagttaatggttaccacttcaaatgtgaaggtgagggagacggtaaccctttcgagggcactcagaacatgcgtatcagggttactgaaggtgctcccttgccatttgcatacgacatcttggcaccttgctgcatgtacggatcaaaaactttcattaaacacacgagtggtatacctgattactttaaggaatctttccccgagggatttacttgggagagaacaactatttacgaggacggtggatatctgacaatccatcaagatacatccttagaaggtaattgtctcatttacaaggtaaaagtattgggaacgaatttcccagcaaatggtccggttatgcaaaagaaaaccgctggttgggagccatgtgtcgaaatgctgtatccaagggatggagtcctttgtggtcagtcccttatggctctgaaatgtactgatggtaatcatctaacaagccatttgagaacaacctatcgttcgagaaaaccatccaacgctgtgaacatgcctgagtttcattttggtgaccacagaatcgaaatcttgaaggcagaacaaggaaagttctatgagcaatacgaatctgccgttgctagatattcagacgtgccagaaaaggccacctga

SEQ ID NO: 179 - protein, 228 aa, Pichia pastoris; identical to SEQ ID NO: 6

SEQ ID NO: 180 - DNA, 687 bp, Pichia pastoris
atggcaagtttagtgaaaaaggacatgtgtatcaaaatgactatggaaggtactgtaaatggatatcatttcaagtgcgttggagagggtgagggtaagccatttgaaggtacacagaacaccagaatacgtgtaactgagggtggaccattgccttttgccttcgatatccttgcaccttgttgcatgtacggctcgaaaaccttcatcaagcacgtctccggcattcctgactatttcaaggaatcattccctgaaggttttacgtgggagagaactcaaatctttgaggatggtggagttctgactgcacatcaagatacatccttagaaggaaattgtttgatttacaaagttaaagtgctaggaacaaacttcccagctaatggtcccgttatgcagaaaaagactgctggctgggagccttgtgtcgaaatgctgtacccccgagacggtgtcttgtgtggtcaatctttgatggctttgaaatgtacagatggtaatcacctgacaagtcatcttagaacaacttaccgttccagaaagccatctaatgcagtgaacatgccagaatttcactttggtgaccataggattgagattctcaaggccgaaagaggtaaattctatgagcaatacgagtcagctgttgctaggtatagcgatgttccagaaaaagctacttga

SEQ ID NO: 181 - protein, 228 aa, Pichia pastoris; identical to SEQ ID NO: 8

SEQ ID NO: 182 - DNA, 687 bp, Pichia pastoris
atggcatctttagtcaaaaaggatatgtgtgtcaaaatgacgatggaaggtaccgtaaacggttaccatttcaaatgcgttggtgagggtgagggaaaacctttcgaaggaactcagaatatgagaattagagttactgaaggtggtccattgccatttgcattcgacatcctggctccatgttgcatgtatggttccaagacatttatcaaacacgtctcaggtataccagattacttcaaggaatcctttcccgagggcttcacttgggaacgtacacagatttttgaggacggcggagtgcttacagcccatcaagacacttctctagaaggtaactgtttgatctacaaagttaaagttttgggtaccaattttcctgcaaatggaccagtgatgcaaaagaaaacagctggttgggagccttgtgtggaaatgttataccctagagatggtgttctgtgtggacaaagcctgatggctctcaaatgtacggatggaaatcacttgacaagccacttgaggactacttatagaagtagaaagccgtccaacgctgtgaatatgcccgaatttcatttcggtgaccatcgtattgagatcttgaaggctgaacaaggaaagttctatgagcaatatgagtcggcagttgcccgttactcagatgtacctgagaaggctacttga

SEQ ID NO: 183 - protein, 228 aa, Pichia pastoris; identical to SEQ ID NO: 9

SEQ ID NO: 184 - DNA, 684 bp, Pichia pastoris
atgtctctttccaaacaagttttgcctcgtgacgtcaagatgagatatcatatggatggttgtgtcaatggtcaccaattcatcatcgagggagaaggaaccggcaaaccgtacgagggtaaaaagatcttagaactgagagtgacaaaaggtggaccactccctttcgctttcgatattctgtcatcagttttcacttacggcaaccgttgtttctgtgagtatcccgaggatatgcctgactactttaaacaatctttgcctgaaggtcatagctgggagaggactttgatgtttgaggatggtggatgtggaactgcttccgcccacattagtttggacaaaaactgcttcgttcataagagcacatttcacggtgttaactttccagctaatggacccgttatgcagaaaaaggcaatgaattgggaaccatcctctgaactaattactgcttgcgatggtatcttgaagggtgacgtgactatgtttttgttactggagggtggtcacagattgaagtgtcaatttaccacatcgtataaagcacataaagcagtgaagatgccaccaaatcatatcattgaacatgtacttgtgaaaaaggaagttgccgatggtttccagatacaagagcacgctgtagctaagcattttacggttgacgtcaaggaaacataatga

SEQ ID NO: 185 - protein, 226 aa, Pichia pastoris
MSLSKQVLPRDVKMRYHMDGCVNGHQFIIEGEGTGKPYEGKKILELRVTKGGPLPFAFDILSSVFTYGNRCFCEYPEDMPDYFKQSLPEGHSWERTLMFEDGGCGTASAHISLDKNCFVHKSTFHGVNFPANGPVMQKKAMNWEPSSELITACDGILKGDVTMFLLLEGGHRLKCQFTTSYKAHKAVKMPPNHIIEHVLVKKEVADGFQIQEHAVAKHFTVDVKET

SEQ ID NO: 186 - DNA, 684 bp, Pichia pastoris
atgagcctaagtaagcaggttttgcctagagatgtcagaatgcgtttccacatggatggttgtgtgaatggtcatcaattcattatagaaggagaaggaactggaaagccgtacgaaggtaaaaagatcttggagctgagagttaccaaaggtggtcccttgccctttgcctttgacattctgtcgtctgtgttcacttatggaaacagatgcttttgtgagtaccctgaggatatgccagactacttcaaacaatcacttccagaaggttattcctgggagcgtactctaatgtttgaggatggtggctgcggcactgcatctgcacatatttctctggagaaaaactgtttcgttcataagtccacattccacggtgtgaattttccagctaatggtccagttatgcagaagaaaactttgaattgggaaccttcaagtgaattgatcactgcatgtgacggtatcttaaagggtgatgtgaccatgtttctcttgcttgaaggaggacataggttaaagtgtcaattcacaacatcctataaagctaaaaaggctgttaagatgccacctaaccatatcattgaacatgtcttggtcaaaaaggaagtagccgacggtttccaaatccaagagcacgctgttgctaaacactttacagttgacgtaaaagagacgtaatga

SEQ ID NO: 187 - protein, 226 aa, Pichia pastoris
MSLSKQVLPRDVRMRFHMDGCVNGHQFIIEGEGTGKPYEGKKILELRVTKGGPLPFAFDILSSVFTYGNRCFCEYPEDMPDYFKQSLPEGYSWERTLMFEDGGCGTASAHISLEKNCFVHKSTFHGVNFPANGPVMQKKTLNWEPSSELITACDGILKGDVTMFLLLEGGHRLKCQFTTSYKAKKAVKMPPNHIIEHVLVKKEVADGFQIQEHAVAKHFTVDVKET

SEQ ID NO: 188 - DNA, 684 bp, Pichia pastoris
atgtctctgtcaaaacaagtgttacctcatgatgtaaagatgagataccacatggatggttgcgtaaacggacattcctttacaattgaaggtgaaggagcaggtaaacccgacgagggtaaaaagatcctggagctacgtgtgacaaagggcggtccattgccattcgctttcgacatcttgtctagtgtctttacttacggtaataggtgtttttgtgaatatccagaagatatgccggactacttcaagcaatctcttccagagggacattcgtgggagagaactctgatgttcgaggatggtggttgcggaactgccagtgctcacatttccttagacaaaaactgttttgttcacaaatccactttccatggagttaactttccagctaatggtcccgtcatgcagaaaaagacgttgaattgggagcctagctcagaattgattacagctggagatggtatcttgaaaggcgacgttactatgttccttatgctcgagggaggtcatagacttaagtgtcaattcaccacatcctataaagcaaagaaagccgttaagatgcctcctaatcatatcattgaacacgtgttggtcaaaaaggaagtggctgatggttttcagatacaagagcatgctgttgcaaaacactttactgttgacgttaaggaaacctaatga

SEQ ID NO: 189 - protein, 226 aa, Pichia pastoris
MSLSKQVLPHDVKMRYHMDGCVNGHSFTIEGEGAGKPDEGKKILELRVTKGGPLPFAFDILSSVFTYGNRCFCEYPEDMPDYFKQSLPEGHSWERTLMFEDGGCGTASAHISLDKNCFVHKSTFHGVNFPANGPVMQKKTLNWEPSSELITAGDGILKGDVTMFLMLEGGHRLKCQFTTSYKAKKAVKMPPNHIIEHVLVKKEVADGFQIQEHAVAKHFTVDVKET

SEQ ID NO: 190 - DNA, 1661 bp, Pichia pastoris
gaattcaaaacgatggccagcttagtgaaaaaggatatgtgcatcaaaatgacgatggaaggaactgtgaacggtcatcactttaagtgtgtcggtgaaggtgagggtaagcctttcgagggtacacagaatatgagaattagagtaactgaaggcgctcctttgccttttgcttttgatatcctgtccccatgttgcgcatatggaagtaagacgttcattaaacatgtttccggaataccagactacttcaaggagagctttccagaaggttttacttgggagcgtaccacaatttacgaagatggaggtgtccttactgcacatcaagacacttcactcgagggtaattgtttgatctacaaggttaaagtcctgggcactaacttccccgctgacggtccagttatgaaaaagatttctggtggttgggagccttgtgtggaaatgctatatcctagagacggtgttttgtgtggacaatctttgatggctttgaaatgtacagatggtaatcatttgacatcacaccttagaacaacctatcgtagtaggaaaccatctaatgccgttaacatgccagaatttcatttcggtgatcacagaatcgagatcttaaaagctgaacagggaaaattctacgaacaatacgagtccgcagtagctcgatattgcgaggctgcaccctcgaagctaggacaccatggcactagtgagggcagaggaagtctgctaacatgcggtgacgtcgaggagaatcctggcccaatgagattcccatctattttcaccgctgtcttgttcgctgcctcctctgcattggctgcccctgttaacactaccactgaagatgagactgctcaaattccagctgaagcagttatcggttactctgaccttgagggtgatttcgacgtcgctgttttgcctttctctaactccactaacaacggtttgttgttcattaacaccactatcgcttccattgctgctaaggaagagggtgtctctctcgagaaaagagaggccgaagctagtcctgttgatttgcaagatagacaattgaccggcggagatgagctaagggatggaccttgtaagcctattactttcatctttgctcgtgcttctactgaacctggcctacttggtataagtacaggacctgctgtatgtaaccgtttgaagctggccagatctggtgacgtagcatgtcagggcgtaggaccacgttacacagcagatctaccttcaaatgctttgccagaggggacttcccaagctgccatcgccgaggcacagggtctattcgaacaggcagtcagtaaatgcccagacactcagatcgtggctggtggttattcacagggaacggccgtgatgaatggggctattaaaagattgagtgcagatgttcaagataaaataaagggtgttgtattgttcggatatactaggaacgcccaggaacgaggacagattgcaaacttccctaaggataaagtaaaggtttactgtgccgtgggtgatcttgtttgtcttggaacattaattgtggctccacctcatttcagttatttgtctgacaccggagatgcctcagattttctgttatctcaactaggacatcatcatcatcaccattgataaggggcggccgc

SEQ ID NO: 191 - protein, 548 aa, Pichia pastoris
EFKTMASLVKKDMCIKMTMEGTVNGHHFKCVGEGEGKPFEGTQNMRIRVTEGAPLPFAFDILSPCCAYGSKTFIKHVSGIPDYFKESFPEGFTWERTTIYEDGGVLTAHQDTSLEGNCLIYKVKVLGTNFPADGPVMKKISGGWEPCVEMLYPRDGVLCGQSLMALKCTDGNHLTSHLRTTYRSRKPSNAVNMPEFHFGDHRIEILKAEQGKFYEQYESAVARYCEAAPSKLGHHGTSEGRGSLLTCGDVEENPGPMRFPSIFTAVLFAASSALAAPVNTTTEDETAQIPAEAVIGYSDLEGDFDVAVLPFSNSTNNGLLFINTTIASIAAKEEGVSLEKREAEASPVDLQDRQLTGGDELRDGPCKPITFIFARASTEPGLLGISTGPAVCNRLKLARSGDVACQGVGPRYTADLPSNALPEGTSQAAIAEAQGLFEQAVSKCPDTQIVAGGYSQGTAVMNGAIKRLSADVQDKIKGVVLFGYTRNAQERGQIANFPKDKVKVYCAVGDLVCLGTLIVAPPHFSYLSDTGDASDFLLSQLGHHHHHH

SEQ ID NO: 192 - DNA, 1394 bp, Pichia pastoris
gaattcaaaacgatggccagcttagtgaaaaaggatatgtgcatcaaaatgacgatggaaggaactgtgaacggtcatcactttaagtgtgtcggtgaaggtgagggtaagcctttcgagggtacacagaatatgagaattagagtaactgaaggcgctcctttgccttttgcttttgatatcctgtccccatgttgcgcatatggaagtaagacgttcattaaacatgtttccggaataccagactacttcaaggagagctttccagaaggttttacttgggagcgtaccacaatttacgaagatggaggtgtccttactgcacatcaagacacttcactcgagggtaattgtttgatctacaaggttaaagtcctgggcactaacttccccgctgacggtccagttatgaaaaagatttctggtggttgggagccttgtgtggaaatgctatatcctagagacggtgttttgtgtggacaatctttgatggctttgaaatgtacagatggtaatcatttgacatcacaccttagaacaacctatcgtagtaggaaaccatctaatgccgttaacatgccagaatttcatttcggtgatcacagaatcgagatcttaaaagctgaacagggaaaattctacgaacaatacgagtccgcagtagctcgatattgcgaggctgcaccctcgaagctaggacaccatggcactagtgagggcagaggaagtctgctaacatgcggtgacgtcgaggaaaatcctggcccaagtcctgttgatttgcaagatagacaattgaccggcggagatgagctaagggatggaccttgtaagcctattactttcatctttgctcgtgcttctactgaacctggcctacttggtataagtacaggacctgctgtatgtaaccgtttgaagctggccagatctggtgacgtagcatgtcagggcgtaggaccacgttacacagcagatctaccttcaaatgctttgccagaggggacttcccaagctgccatcgccgaggcacagggtctattcgaacaggcagtcagtaaatgcccagacactcagatcgtggctggtggttattcacagggaacggccgtgatgaatggggctattaaaagattgagtgcagatgttcaagataaaataaagggtgttgtattgttcggatatactaggaacgcccaggaacgaggacagattgcaaacttccctaaggataaagtaaaggtttactgtgccgtgggtgatcttgtttgtcttggaacattaattgtggctccacctcatttcagttatttgtctgacaccggagatgcctcagattttctgttatctcaactaggacatcatcatcatcaccattgataaggggcggccgc

SEQ ID NO: 193 - protein, 459 aa, Pichia pastoris
EFKTMASLVKKDMCIKMTMEGTVNGHHFKCVGEGEGKPFEGTQNMRIRVTEGAPLPFAFDILSPCCAYGSKTFIKHVSGIPDYFKESFPEGFTWERTTIYEDGGVLTAHQDTSLEGNCLIYKVKVLGTNFPADGPVMKKISGGWEPCVEMLYPRDGVLCGQSLMALKCTDGNHLTSHLRTTYRSRKPSNAVNMPEFHFGDHRIEILKAEQGKFYEQYESAVARYCEAAPSKLGHHGTSEGRGSLLTCGDVEENPGPSPVDLQDRQLTGGDELRDGPCKPITFIFARASTEPGLLGISTGPAVCNRLKLARSGDVACQGVGPRYTADLPSNALPEGTSQAAIAEAQGLFEQAVSKCPDTQIVAGGYSQGTAVMNGAIKRLSADVQDKIKGVVLFGYTRNAQERGQIANFPKDKVKVYCAVGDLVCLGTLIVAPPHFSYLSDTGDASDFLLSQLGHHHHHH

SEQ ID NO: 194 - DNA, 3837 bp, Pichia pastoris
atggccagcttagtgaaaaaggatatgtgcatcaaaatgacgatggaaggaactgtgaacggtcatcactttaagtgtgtcggtgaaggtgagggtaagcctttcgagggtacacagaatatgagaattagagtaactgaaggcgctcctttgccttttgcttttgatatcctgtccccatgttgcgcatatggaagtaagacgttcattaaacatgtttccggaataccagactacttcaaggagagctttccagaaggttttacttgggagcgtaccacaatttacgaagatggaggtgtccttactgcacatcaagacacttcactcgagggtaattgtttgatctacaaggttaaagtcctgggcactaacttccccgctgacggtccagttatgaaaaagatttctggtggttgggagccttgtgtggaaatgctatatcctagagacggtgttttgtgtggacaatctttgatggctttgaaatgtacagatggtaatcatttgacatcacaccttagaacaacctatcgtagtaggaaaccatctaatgccgttaacatgccagaatttcatttcggtgatcacagaatcgagatcttaaaagctgaacagggaaaattctacgaacaatacgagtccgcagtagctcgatattgcgaggctgcaccctcgaagctaggacaccatggcactagtgagggcagaggaagtctgctaacatgcggtgacgtcgaggagaatcctggcccaatggacgtaagatgcatcaattggttcgaatcgcacggagaaaatcgtttcctgtatttgaagtctagatgtagaaacggtgagacagtctttatcagatttccacattacttctactacgtggtgacagacgagatttatcaatccttaagcccgccaccattcaatgctagacctcttggtaagatgaggactattgacatcgacgaaactatttcatacaatttggacataaaagaccgtaagtgttctgtggccgatatgtggttgatagaagagcctaaaaagaggtctatccaaaatgccactatggatgagttcctgaacataagttggttctacatttcaaacggaatatcgccagacggttgttactccttggacgaacaatacctcacaaagattaacaatggatgttatcattgtgatgaccctaggaattgctttgctaaaaagattccaagatttgacatccccagaagttacttattccttgacatcgaatgtcactttgacaagaaattcccatcagtgttcatcaatcctatcagtcacacatcatattgttacattgatttatccggtaaacgattgctgtttaccttgatcaatgaggagatgttgactgaacaagagattcaagaggctgtcgatagaggttgtctgagaatccagtcattgatggaaatggattacgagagagaactagtcttgtgcagtgagatagtactgctcagaatagctaaacaactgcttgaactgaccttcgattatgttgtcactttcaatggacacaattttgatttacgttacatcaccaatcgtttggaacttctgactggtgaaaagataatcttccgtagcccagataagaaagaggccgttcacttgtgcatatatgagcgtaatcaatcctcccataaaggtgtcggcggaatggcaaatacaactttccatgtcaacaacaataatggtacaatctttttcgacttatactcctttattcagaaaagtgagaagttggatagctataaactagattccattagcaaaaatgcattctcatgtatgggaaaggttttgaataggggtgtgcgtgaaatgacctttattggtgatgacacaactgatgctaagggaaaagctgcagcatttgcaaaggttttaacgactggaaattacgtgacagtggacgaggatatcatttgtaaggttattcgaaaagatatatgggagaatggctttaaagttgtcttgttgtgtcccacccttccaaatgatacttacaagctcagtttcggtaaagacgatgttgatcttgcacaaatgtataaagactacaatttgaatattgcattagatatggctagatattgcatccatgatgcttgcttgtgtcagtacctttgggaatactatggtgttgaaacaaaaactgatgctggagcttccacttacgtgctcccccaaagcatggtattcgaatatagagcttcaacagttatcaaaggtcctctcttgaagttattacttgagacaaagactattctagtccgttccgaaactaagcagaaatttccctatgagggtggtaaggtttttgctcctaaacaaaagatgttttctaacaacgttttgatttttgactacaatagcctttacccaaacgtttgtattttcggtaacctgtctcctgaaacattagtcggtgttgtggtatccacaaataggcttgaagaggagatcaataatcaactgttgttgcaaaagtatccaccacctcgatatatcactgtgcattgtgagccaagattgccaaatttgatttccgaaattgctatctttgataggagtatcgaaggtacgatccccagattgttgagaacttttctggctgagagggctcgttacaaaaagatgttgaaacaggccacaagctccacggaaaaggctatttacgattctatgcagtacacttacaaaattgtggcaaattccgtttatggtttgatgggtttcagaaatagcgctttgtattcctacgcatctgctaaaagctgtacttctatcggacgtcgtatgatcctatacttggagtccgtcctgaacggagcagaattgtctaacggcatgctgagattcgcaaatccactgtccaaccctttctatatggatgatcgtgatatcaacccaattgtgaaaacgtcattgcctattgattataggtttagattcagatccgtatatggtgatactgacagcgtgttcacagagatcgacagccaggacgttgataaatccattgaaattgccaaggaacttgagagactgattaacaacagagtacttttcaataactttaagatagagtttgaagctgtttacaagaatttgataatgcaatctaaaaagaagtatactacaatgaaatactctgcatcgtccaattctaaatccgtgccagaacgtatcaataaaggaacttccgagacgagaagggacgtctccaaattccataagaatatgatcaaaacatataagactagactttcagaaatgctttcggaaggcaggatgaactccaatcaggtttgcatcgacatccttcgttcattggagactgatttaagatcagagtttgactcgagaagctctccattggaacttttcatgctgtcacgtatgcatcacagcaactacaagtctgccgataatcctaacatgtatctcgttaccgagtataacaaaaacaaccctgaaacaatcgagttgggtgagagatactattttgcatacatttgtcctgcaaacgttccttggactaaaaagctagttaacatcaaaacttatgaaactatcatcgacagatctttcaaattgggttcagatcaaaggatcttctatgaggtttactttaagagattaacgtcagaaatcgttaatctgttggacaataaagtcctgtgtatctcatttttcgaaaggatgtttggttctaaaccaaccttttacgaagcttccggtggaggcggaagcggtggaggtggaagccatcatcaccaccatcaccatcactaatga

SEQ ID NO: 195 - protein, 1277 aa, Pichia pastoris
MASLVKKDMCIKMTMEGTVNGHHFKCVGEGEGKPFEGTQNMRIRVTEGAPLPFAFDILSPCCAYGSKTFIKHVSGIPDYFKESFPEGFTWERTTIYEDGGVLTAHQDTSLEGNCLIYKVKVLGTNFPADGPVMKKISGGWEPCVEMLYPRDGVLCGQSLMALKCTDGNHLTSHLRTTYRSRKPSNAVNMPEFHFGDHRIEILKAEQGKFYEQYESAVARYCEAAPSKLGHHGTSEGRGSLLTCGDVEENPGPMDVRCINWFESHGENRFLYLKSRCRNGETVFIRFPHYFYYVVTDEIYQSLSPPPFNARPLGKMRTIDIDETISYNLDIKDRKCSVADMWLIEEPKKRSIQNATMDEFLNISWFYISNGISPDGCYSLDEQYLTKINNGCYHCDDPRNCFAKKIPRFDIPRSYLFLDIECHFDKKFPSVFINPISHTSYCYIDLSGKRLLFTLINEEMLTEQEIQEAVDRGCLRIQSLMEMDYERELVLCSEIVLLRIAKQLLELTFDYVVTFNGHNFDLRYITNRLELLTGEKIIFRSPDKKEAVHLCIYERNQSSHKGVGGMANTTFHVNNNNGTIFFDLYSFIQKSEKLDSYKLDSISKNAFSCMGKVLNRGVREMTFIGDDTTDAKGKAAAFAKVLTTGNYVTVDEDIICKVIRKDIWENGFKVVLLCPTLPNDTYKLSFGKDDVDLAQMYKDYNLNIALDMARYCIHDACLCQYLWEYYGVETKTDAGASTYVLPQSMVFEYRASTVIKGPLLKLLLETKTILVRSETKQKFPYEGGKVFAPKQKMFSNNVLIFDYNSLYPNVCIFGNLSPETLVGVVVSTNRLEEEINNQLLLQKYPPPRYITVHCEPRLPNLISEIAIFDRSIEGTIPRLLRTFLAERARYKKMLKQATSSTEKAIYDSMQYTYKIVANSVYGLMGFRNSALYSYASAKSCTSIGRRMILYLESVLNGAELSNGMLRFANPLSNPFYMDDRDINPIVKTSLPIDYRFRFRSVYGDTDSVFTEIDSQDVDKSIEIAKELERLINNRVLFNNFKIEFEAVYKNLIMQSKKKYTTMKYSASSNSKSVPERINKGTSETRRDVSKFHKNMIKTYKTRLSEMLSEGRMNSNQVCIDILRSLETDLRSEFDSRSSPLELFMLSRMHHSNYKSADNPNMYLVTEYNKNNPETIELGERYYFAYICPANVPWTKKLVNIKTYETIIDRSFKLGSDQRIFYEVYFKRLTSEIVNLLDNKVLCISFFERMFGSKPTFYEASGGGGSGGGGSHHHHHHHH

SEQ ID NO: 196 - DNA, 3837 bp, Pichia pastoris
atgtccaaaatctcagacaacgttcgtatcaaactatacatggagggtaccgtcaataatcatcactttatgtgtgaagctgaaggagagggaaaaccatacgagggtacacaggagatgaagattgaagttatagaaggtggtcctctgccattcgcttttcacattttgtcaacttcctgcatgtatggaagcaagacctttatcaaatatgtgtccggtatccctgactacttcaagcaatcgttcccagaaggatttacttgggagagaactacaacttatgaggatggaggctttctgacagcacatcaggacacatctttagatggtgactgtttggtctacaaagtaaagattttgggtaacaatttccctgcagatggtccagtgatgcaaaacaaggccgagaggtgggagcccgctactgaaatcttgtatgaagttgatggtgtgcttagaggtcaaacactaatggctcttaaatgtgctgatggaaatcatttgacctgtcatctcagaacgacttacagaagtaaaaagccagccagcgcattgaagatgcccggattccatttcggtgaccaccgtattgaaatcatggaagaggtagaaaaaggcaagtgttacaagcaatatgaggctgccgttgcaagatactgcgatgcagctccttctaaactgggtcatcacggcactagtgagggcagaggaagtctgctaacatgcggtgacgtcgaggagaatcctggcccaatggacgtaagatgcatcaattggttcgaatcgcacggagaaaatcgtttcctgtatttgaagtctagatgtagaaacggtgagacagtctttatcagatttccacattacttctactacgtggtgacagacgagatttatcaatccttaagcccgccaccattcaatgctagacctcttggtaagatgaggactattgacatcgacgaaactatttcatacaatttggacataaaagaccgtaagtgttctgtggccgatatgtggttgatagaagagcctaaaaagaggtctatccaaaatgccactatggatgagttcctgaacataagttggttctacatttcaaacggaatatcgccagacggttgttactccttggacgaacaatacctcacaaagattaacaatggatgttatcattgtgatgaccctaggaattgctttgctaaaaagattccaagatttgacatccccagaagttacttattccttgacatcgaatgtcactttgacaagaaattcccatcagtgttcatcaatcctatcagtcacacatcatattgttacattgatttatccggtaaacgattgctgtttaccttgatcaatgaggagatgttgactgaacaagagattcaagaggctgtcgatagaggttgtctgagaatccagtcattgatggaaatggattacgagagagaactagtcttgtgcagtgagatagtactgctcagaatagctaaacaactgcttgaactgaccttcgattatgttgtcactttcaatggacacaattttgatttacgttacatcaccaatcgtttggaacttctgactggtgaaaagataatcttccgtagcccagataagaaagaggccgttcacttgtgcatatatgagcgtaatcaatcctcccataaaggtgtcggcggaatggcaaatacaactttccatgtcaacaacaataatggtacaatctttttcgacttatactcctttattcagaaaagtgagaagttggatagctataaactagattccattagcaaaaatgcattctcatgtatgggaaaggttttgaataggggtgtgcgtgaaatgacctttattggtgatgacacaactgatgctaagggaaaagctgcagcatttgcaaaggttttaacgactggaaattacgtgacagtggacgaggatatcatttgtaaggttattcgaaaagatatatgggagaatggctttaaagttgtcttgttgtgtcccacccttccaaatgatacttacaagctcagtttcggtaaagacgatgttgatcttgcacaaatgtataaagactacaatttgaatattgcattagatatggctagatattgcatccatgatgcttgcttgtgtcagtacctttgggaatactatggtgttgaaacaaaaactgatgctggagcttccacttacgtgctcccccaaagcatggtattcgaatatagagcttcaacagttatcaaaggtcctctcttgaagttattacttgagacaaagactattctagtccgttccgaaactaagcagaaatttccctatgagggtggtaaggtttttgctcctaaacaaaagatgttttctaacaacgttttgatttttgactacaatagcctttacccaaacgtttgtattttcggtaacctgtctcctgaaacattagtcggtgttgtggtatccacaaataggcttgaagaggagatcaataatcaactgttgttgcaaaagtatccaccacctcgatatatcactgtgcattgtgagccaagattgccaaatttgatttccgaaattgctatctttgataggagtatcgaaggtacgatccccagattgttgagaacttttctggctgagagggctcgttacaaaaagatgttgaaacaggccacaagctccacggaaaaggctatttacgattctatgcagtacacttacaaaattgtggcaaattccgtttatggtttgatgggtttcagaaatagcgctttgtattcctacgcatctgctaaaagctgtacttctatcggacgtcgtatgatcctatacttggagtccgtcctgaacggagcagaattgtctaacggcatgctgagattcgcaaatccactgtccaaccctttctatatggatgatcgtgatatcaacccaattgtgaaaacgtcattgcctattgattataggtttagattcagatccgtatatggtgatactgacagcgtgttcacagagatcgacagccaggacgttgataaatccattgaaattgccaaggaacttgagagactgattaacaacagagtacttttcaataactttaagatagagtttgaagctgtttacaagaatttgataatgcaatctaaaaagaagtatactacaatgaaatactctgcatcgtccaattctaaatccgtgccagaacgtatcaataaaggaacttccgagacgagaagggacgtctccaaattccataagaatatgatcaaaacatataagactagactttcagaaatgctttcggaaggcaggatgaactccaatcaggtttgcatcgacatccttcgttcattggagactgatttaagatcagagtttgactcgagaagctctccattggaacttttcatgctgtcacgtatgcatcacagcaactacaagtctgccgataatcctaacatgtatctcgttaccgagtataacaaaaacaaccctgaaacaatcgagttgggtgagagatactattttgcatacatttgtcctgcaaacgttccttggactaaaaagctagttaacatcaaaacttatgaaactatcatcgacagatctttcaaattgggttcagatcaaaggatcttctatgaggtttactttaagagattaacgtcagaaatcgttaatctgttggacaataaagtcctgtgtatctcatttttcgaaaggatgtttggttctaaaccaaccttttacgaagcttccggtggaggcggaagcggtggaggtggaagccatcatcaccaccatcaccatcactaatga

SEQ ID NO: 197 - protein, 1277 aa, Pichia pastoris
MSKISDNVRIKLYMEGTVNNHHFMCEAEGEGKPYEGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKAERWEPATEILYEVDGVLRGQTLMALKCADGNHLTCHLRTTYRSKKPASALKMPGFHFGDHRIEIMEEVEKGKCYKQYEAAVARYCDAAPSKLGHHGTSEGRGSLLTCGDVEENPGPMDVRCINWFESHGENRFLYLKSRCRNGETVFIRFPHYFYYVVTDEIYQSLSPPPFNARPLGKMRTIDIDETISYNLDIKDRKCSVADMWLIEEPKKRSIQNATMDEFLNISWFYISNGISPDGCYSLDEQYLTKINNGCYHCDDPRNCFAKKIPRFDIPRSYLFLDIECHFDKKFPSVFINPISHTSYCYIDLSGKRLLFTLINEEMLTEQEIQEAVDRGCLRIQSLMEMDYERELVLCSEIVLLRIAKQLLELTFDYVVTFNGHNFDLRYITNRLELLTGEKIIFRSPDKKEAVHLCIYERNQSSHKGVGGMANTTFHVNNNNGTIFFDLYSFIQKSEKLDSYKLDSISKNAFSCMGKVLNRGVREMTFIGDDTTDAKGKAAAFAKVLTTGNYVTVDEDIICKVIRKDIWENGFKVVLLCPTLPNDTYKLSFGKDDVDLAQMYKDYNLNIALDMARYCIHDACLCQYLWEYYGVETKTDAGASTYVLPQSMVFEYRASTVIKGPLLKLLLETKTILVRSETKQKFPYEGGKVFAPKQKMFSNNVLIFDYNSLYPNVCIFGNLSPETLVGVVVSTNRLEEEINNQLLLQKYPPPRYITVHCEPRLPNLISEIAIFDRSIEGTIPRLLRTFLAERARYKKMLKQATSSTEKAIYDSMQYTYKIVANSVYGLMGFRNSALYSYASAKSCTSIGRRMILYLESVLNGAELSNGMLRFANPLSNPFYMDDRDINPIVKTSLPIDYRFRFRSVYGDTDSVFTEIDSQDVDKSIEIAKELERLINNRVLFNNFKIEFEAVYKNLIMQSKKKYTTMKYSASSNSKSVPERINKGTSETRRDVSKFHKNMIKTYKTRLSEMLSEGRMNSNQVCIDILRSLETDLRSEFDSRSSPLELFMLSRMHHSNYKSADNPNMYLVTEYNKNNPETIELGERYYFAYICPANVPWTKKLVNIKTYETIIDRSFKLGSDQRIFYEVYFKRLTSEIVNLLDNKVLCISFFERMFGSKPTFYEASGGGGSGGGGSHHHHHHHH

SEQ ID NO: 198 - DNA, 3828 bp, Pichia pastoris
atggcaagtttagtgaaaaaggacatgtgtatcaaaatgactatggaaggtactgtaaatggatatcatttcaagtgcgttggagagggtgagggtaagccatttgaaggtacacagaacaccagaatacgtgtaactgagggtggaccattgccttttgccttcgatatccttgcaccttgttgcatgtacggctcgaaaaccttcatcaagcacgtctccggcattcctgactatttcaaggaatcattccctgaaggttttacgtgggagagaactcaaatctttgaggatggtggagttctgactgcacatcaagatacatccttagaaggaaattgtttgatttacaaagttaaagtgctaggaacaaacttcccagctaatggtcccgttatgcagaaaaagactgctggctgggagccttgtgtcgaaatgctgtacccccgagacggtgtcttgtgtggtcaatctttgatggctttgaaatgtacagatggtaatcacctgacaagtcatcttagaacaacttaccgttccagaaagccatctaatgcagtgaacatgccagaatttcactttggtgaccataggattgagattctcaaggccgaaagaggtaaattctatgagcaatacgagtcagctgttgctaggtatagcgatgttccagaaaaagctactggcactagtgagggcagaggaagtctgctaacatgcggtgacgtcgaggagaatcctggcccaatggacgtaagatgcatcaattggttcgaatcgcacggagaaaatcgtttcctgtatttgaagtctagatgtagaaacggtgagacagtctttatcagatttccacattacttctactacgtggtgacagacgagatttatcaatccttaagcccgccaccattcaatgctagacctcttggtaagatgaggactattgacatcgacgaaactatttcatacaatttggacataaaagaccgtaagtgttctgtggccgatatgtggttgatagaagagcctaaaaagaggtctatccaaaatgccactatggatgagttcctgaacataagttggttctacatttcaaacggaatatcgccagacggttgttactccttggacgaacaatacctcacaaagattaacaatggatgttatcattgtgatgaccctaggaattgctttgctaaaaagattccaagatttgacatccccagaagttacttattccttgacatcgaatgtcactttgacaagaaattcccatcagtgttcatcaatcctatcagtcacacatcatattgttacattgatttatccggtaaacgattgctgtttaccttgatcaatgaggagatgttgactgaacaagagattcaagaggctgtcgatagaggttgtctgagaatccagtcattgatggaaatggattacgagagagaactagtcttgtgcagtgagatagtactgctcagaatagctaaacaactgcttgaactgaccttcgattatgttgtcactttcaatggacacaattttgatttacgttacatcaccaatcgtttggaacttctgactggtgaaaagataatcttccgtagcccagataagaaagaggccgttcacttgtgcatatatgagcgtaatcaatcctcccataaaggtgtcggcggaatggcaaatacaactttccatgtcaacaacaataatggtacaatctttttcgacttatactcctttattcagaaaagtgagaagttggatagctataaactagattccattagcaaaaatgcattctcatgtatgggaaaggttttgaataggggtgtgcgtgaaatgacctttattggtgatgacacaactgatgctaagggaaaagctgcagcatttgcaaaggttttaacgactggaaattacgtgacagtggacgaggatatcatttgtaaggttattcgaaaagatatatgggagaatggctttaaagttgtcttgttgtgtcccacccttccaaatgatacttacaagctcagtttcggtaaagacgatgttgatcttgcacaaatgtataaagactacaatttgaatattgcattagatatggctagatattgcatccatgatgcttgcttgtgtcagtacctttgggaatactatggtgttgaaacaaaaactgatgctggagcttccacttacgtgctcccccaaagcatggtattcgaatatagagcttcaacagttatcaaaggtcctctcttgaagttattacttgagacaaagactattctagtccgttccgaaactaagcagaaatttccctatgagggtggtaaggtttttgctcctaaacaaaagatgttttctaacaacgttttgatttttgactacaatagcctttacccaaacgtttgtattttcggtaacctgtctcctgaaacattagtcggtgttgtggtatccacaaataggcttgaagaggagatcaataatcaactgttgttgcaaaagtatccaccacctcgatatatcactgtgcattgtgagccaagattgccaaatttgatttccgaaattgctatctttgataggagtatcgaaggtacgatccccagattgttgagaacttttctggctgagagggctcgttacaaaaagatgttgaaacaggccacaagctccacggaaaaggctatttacgattctatgcagtacacttacaaaattgtggcaaattccgtttatggtttgatgggtttcagaaatagcgctttgtattcctacgcatctgctaaaagctgtacttctatcggacgtcgtatgatcctatacttggagtccgtcctgaacggagcagaattgtctaacggcatgctgagattcgcaaatccactgtccaaccctttctatatggatgatcgtgatatcaacccaattgtgaaaacgtcattgcctattgattataggtttagattcagatccgtatatggtgatactgacagcgtgttcacagagatcgacagccaggacgttgataaatccattgaaattgccaaggaacttgagagactgattaacaacagagtacttttcaataactttaagatagagtttgaagctgtttacaagaatttgataatgcaatctaaaaagaagtatactacaatgaaatactctgcatcgtccaattctaaatccgtgccagaacgtatcaataaaggaacttccgagacgagaagggacgtctccaaattccataagaatatgatcaaaacatataagactagactttcagaaatgctttcggaaggcaggatgaactccaatcaggtttgcatcgacatccttcgttcattggagactgatttaagatcagagtttgactcgagaagctctccattggaacttttcatgctgtcacgtatgcatcacagcaactacaagtctgccgataatcctaacatgtatctcgttaccgagtataacaaaaacaaccctgaaacaatcgagttgggtgagagatactattttgcatacatttgtcctgcaaacgttccttggactaaaaagctagttaacatcaaaacttatgaaactatcatcgacagatctttcaaattgggttcagatcaaaggatcttctatgaggtttactttaagagattaacgtcagaaatcgttaatctgttggacaataaagtcctgtgtatctcatttttcgaaaggatgtttggttctaaaccaaccttttacgaagcttccggtggaggcggaagcggtggaggtggaagccatcatcaccaccatcaccatcactaatga

SEQ ID NO: 199 - protein, 1274 aa, Pichia pastoris
MASLVKKDMCIKMTMEGTVNGYHFKCVGEGEGKPFEGTQNTRIRVTEGGPLPFAFDILAPCCMYGSKTFIKHVSGIPDYFKESFPEGFTWERTQIFEDGGVLTAHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAERGKFYEQYESAVARYSDVPEKATGTSEGRGSLLTCGDVEENPGPMDVRCINWFESHGENRFLYLKSRCRNGETVFIRFPHYFYYVVTDEIYQSLSPPPFNARPLGKMRTIDIDETISYNLDIKDRKCSVADMWLIEEPKKRSIQNATMDEFLNISWFYISNGISPDGCYSLDEQYLTKINNGCYHCDDPRNCFAKKIPRFDIPRSYLFLDIECHFDKKFPSVFINPISHTSYCYIDLSGKRLLFTLINEEMLTEQEIQEAVDRGCLRIQSLMEMDYERELVLCSEIVLLRIAKQLLELTFDYVVTFNGHNFDLRYITNRLELLTGEKIIFRSPDKKEAVHLCIYERNQSSHKGVGGMANTTFHVNNNNGTIFFDLYSFIQKSEKLDSYKLDSISKNAFSCMGKVLNRGVREMTFIGDDTTDAKGKAAAFAKVLTTGNYVTVDEDIICKVIRKDIWENGFKVVLLCPTLPNDTYKLSFGKDDVDLAQMYKDYNLNIALDMARYCIHDACLCQYLWEYYGVETKTDAGASTYVLPQSMVFEYRASTVIKGPLLKLLLETKTILVRSETKQKFPYEGGKVFAPKQKMFSNNVLIFDYNSLYPNVCIFGNLSPETLVGVVVSTNRLEEEINNQLLLQKYPPPRYITVHCEPRLPNLISEIAIFDRSIEGTIPRLLRTFLAERARYKKMLKQATSSTEKAIYDSMQYTYKIVANSVYGLMGFRNSALYSYASAKSCTSIGRRMILYLESVLNGAELSNGMLRFANPLSNPFYMDDRDINPIVKTSLPIDYRFRFRSVYGDTDSVFTEIDSQDVDKSIEIAKELERLINNRVLFNNFKIEFEAVYKNLIMQSKKKYTTMKYSASSNSKSVPERINKGTSETRRDVSKFHKNMIKTYKTRLSEMLSEGRMNSNQVCIDILRSLETDLRSEFDSRSSPLELFMLSRMHHSNYKSADNPNMYLVTEYNKNNPETIELGERYYFAYICPANVPWTKKLVNIKTYETIIDRSFKLGSDQRIFYEVYFKRLTSEIVNLLDNKVLCISFFERMFGSKPTFYEASGGGGSGGGGSHHHHHHHH

SEQ ID NO: 200 - DNA, 1653 bp, Pichia pastoris
atggctagcttagtgaaaaaggatatgtgtattaagatgactatggagggcacagttaatggttaccacttcaaatgtgaaggtgagggagacggtaaccctttcgagggcactcagaacatgcgtatcagggttactgaaggtgctcccttgccatttgcatacgacatcttggcaccttgctgcatgtacggatcaaaaactttcattaaacacacgagtggtatacctgattactttaaggaatctttccccgagggatttacttgggagagaacaactatttacgaggacggtggatatctgacaatccatcaagatacatccttagaaggtaattgtctcatttacaaggtaaaagtattgggaacgaatttcccagcaaatggtccggttatgcaaaagaaaaccgctggttgggagccatgtgtcgaaatgctgtatccaagggatggagtcctttgtggtcagtcccttatggctctgaaatgtactgatggtaatcatctaacaagccatttgagaacaacctatcgttcgagaaaaccatccaacgctgtgaacatgcctgagtttcattttggtgaccacagaatcgaaatcttgaaggcagaacaaggaaagttctatgagcaatacgaatctgccgttgctagatattcagacgtgccagaaaaggccaccgattacaaggatgatgacgataagggcgctggcactagtgagggcagaggaagtctgctaacatgcggtgacgtcgaggagaatcctggcccaatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagattaggaagaacaacaagagacgatctgataaatggaaattctgcctcctgtgctgatgttatatttatatatgcccgaggctctacagaaactggcaatttgggaactttgggcccatctattgcttctaaccttgaatctgcttttggtaaggatggagtttggattcagggcgtgggtggagcctatgctgccactttgggtgacaatgctttgccaagaggtacatcctcagccgctattcgtgagatgttaggtttatttcagcaggctaacactaagtgtcccgatgcaacattgattgcaggtggatattctcaaggtgccgccttggccgccgcttctattgaagaccttgatagtgcaataagggacaagattgcaggtacagttttgtttggttacaccaagaatctacaaaacagaggtcgaatccccaattacccagctgacagaacgaaggtcttttgtaatacaggcgaccttgtgtgtaccggatctttgatagtcgctgctccccatttggcttacggaccagatgctagaggtccagcacccgaattcttgattgagaaagtacgtgctgttagaggttcagcccatcatcatcatcaccattga

SEQ ID NO: 201 - protein, 550 aa, Pichia pastoris
MASLVKKDMCIKMTMEGTVNGYHFKCEGEGDGNPFEGTQNMRIRVTEGAPLPFAYDILAPCCMYGSKTFIKHTSGIPDYFKESFPEGFTWERTTIYEDGGYLTIHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAEQGKFYEQYESAVARYSDVPEKATDYKDDDDKGAGTSEGRGSLLTCGDVEENPGPMRFPSIFTAVLFAASSALAAPVNTTTEDETAQIPAEAVIGYSDLEGDFDVAVLPFSNSTNNGLLFINTTIASIAAKEEGVSLEKRLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSAHHHHHH

SEQ ID NO: 202 - DNA, 1656 bp, Pichia pastoris
atggctagcttagtgaaaaaggatatgtgtattaagatgactatggagggcacagttaatggttaccacttcaaatgtgaaggtgagggagacggtaaccctttcgagggcactcagaacatgcgtatcagggttactgaaggtgctcccttgccatttgcatacgacatcttggcaccttgctgcatgtacggatcaaaaactttcattaaacacacgagtggtatacctgattactttaaggaatctttccccgagggatttacttgggagagaacaactatttacgaggacggtggatatctgacaatccatcaagatacatccttagaaggtaattgtctcatttacaaggtaaaagtattgggaacgaatttcccagcaaatggtccggttatgcaaaagaaaaccgctggttgggagccatgtgtcgaaatgctgtatccaagggatggagtcctttgtggtcagtcccttatggctctgaaatgtactgatggtaatcatctaacaagccatttgagaacaacctatcgttcgagaaaaccatccaacgctgtgaacatgcctgagtttcattttggtgaccacagaatcgaaatcttgaaggcagaacaaggaaagttctatgagcaatacgaatctgccgttgctagatattcagacgtgccagaaaaggccaccgattacaaggatgatgacgataagggcgctggcactagttacgctggatattttgccgatttgctcatccatgacattgaaactaacccaggtcctatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagattaggaagaacaacaagagacgatctgataaatggaaattctgcctcctgtgctgatgttatatttatatatgcccgaggctctacagaaactggcaatttgggaactttgggcccatctattgcttctaaccttgaatctgcttttggtaaggatggagtttggattcagggcgtgggtggagcctatgctgccactttgggtgacaatgctttgccaagaggtacatcctcagccgctattcgtgagatgttaggtttatttcagcaggctaacactaagtgtcccgatgcaacattgattgcaggtggatattctcaaggtgccgccttggccgccgcttctattgaagaccttgatagtgcaataagggacaagattgcaggtacagttttgtttggttacaccaagaatctacaaaacagaggtcgaatccccaattacccagctgacagaacgaaggtcttttgtaatacaggcgaccttgtgtgtaccggatctttgatagtcgctgctccccatttggcttacggaccagatgctagaggtccagcacccgaattcttgattgagaaagtacgtgctgttagaggttcagcccatcatcatcatcaccattga

SEQ ID NO: 203 - protein, 551 aa, Pichia pastoris
MASLVKKDMCIKMTMEGTVNGYHFKCEGEGDGNPFEGTQNMRIRVTEGAPLPFAYDILAPCCMYGSKTFIKHTSGIPDYFKESFPEGFTWERTTIYEDGGYLTIHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAEQGKFYEQYESAVARYSDVPEKATDYKDDDDKGAGTSYAGYFADLLIHDIETNPGPMRFPSIFTAVLFAASSALAAPVNTTTEDETAQIPAEAVIGYSDLEGDFDVAVLPFSNSTNNGLLFINTTIASIAAKEEGVSLEKRLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSAHHHHHH

SEQ ID NO: 204 - DNA, 1653 bp, Pichia pastoris
atggcaagtttagtgaaaaaggacatgtgtatcaaaatgactatggaaggtactgtaaatggatatcatttcaagtgcgttggagagggtgagggtaagccatttgaaggtacacagaacaccagaatacgtgtaactgagggtggaccattgccttttgccttcgatatccttgcaccttgttgcatgtacggctcgaaaaccttcatcaagcacgtctccggcattcctgactatttcaaggaatcattccctgaaggttttacgtgggagagaactcaaatctttgaggatggtggagttctgactgcacatcaagatacatccttagaaggaaattgtttgatttacaaagttaaagtgctaggaacaaacttcccagctaatggtcccgttatgcagaaaaagactgctggctgggagccttgtgtcgaaatgctgtacccccgagacggtgtcttgtgtggtcaatctttgatggctttgaaatgtacagatggtaatcacctgacaagtcatcttagaacaacttaccgttccagaaagccatctaatgcagtgaacatgccagaatttcactttggtgaccataggattgagattctcaaggccgaaagaggtaaattctatgagcaatacgagtcagctgttgctaggtatagcgatgttccagaaaaagctactgattacaaggatgatgacgataagggcgctggcactagtgagggcagaggaagtctgctaacatgcggtgacgtcgaggagaatcctggcccaatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagattaggaagaacaacaagagacgatctgataaatggaaattctgcctcctgtgctgatgttatatttatatatgcccgaggctctacagaaactggcaatttgggaactttgggcccatctattgcttctaaccttgaatctgcttttggtaaggatggagtttggattcagggcgtgggtggagcctatgctgccactttgggtgacaatgctttgccaagaggtacatcctcagccgctattcgtgagatgttaggtttatttcagcaggctaacactaagtgtcccgatgcaacattgattgcaggtggatattctcaaggtgccgccttggccgccgcttctattgaagaccttgatagtgcaataagggacaagattgcaggtacagttttgtttggttacaccaagaatctacaaaacagaggtcgaatccccaattacccagctgacagaacgaaggtcttttgtaatacaggcgaccttgtgtgtaccggatctttgatagtcgctgctccccatttggcttacggaccagatgctagaggtccagcacccgaattcttgattgagaaagtacgtgctgttagaggttcagcccatcatcatcatcaccattga

SEQ ID NO: 205 - protein, 550 aa, Pichia pastoris
MASLVKKDMCIKMTMEGTVNGYHFKCVGEGEGKPFEGTQNTRIRVTEGGPLPFAFDILAPCCMYGSKTFIKHVSGIPDYFKESFPEGFTWERTQIFEDGGVLTAHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAERGKFYEQYESAVARYSDVPEKATDYKDDDDKGAGTSEGRGSLLTCGDVEENPGPMRFPSIFTAVLFAASSALAAPVNTTTEDETAQIPAEAVIGYSDLEGDFDVAVLPFSNSTNNGLLFINTTIASIAAKEEGVSLEKRLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSAHHHHHH

SEQ ID NO: 206 - DNA, 1656 bp, Pichia pastoris
atggcaagtttagtgaaaaaggacatgtgtatcaaaatgactatggaaggtactgtaaatggatatcatttcaagtgcgttggagagggtgagggtaagccatttgaaggtacacagaacaccagaatacgtgtaactgagggtggaccattgccttttgccttcgatatccttgcaccttgttgcatgtacggctcgaaaaccttcatcaagcacgtctccggcattcctgactatttcaaggaatcattccctgaaggttttacgtgggagagaactcaaatctttgaggatggtggagttctgactgcacatcaagatacatccttagaaggaaattgtttgatttacaaagttaaagtgctaggaacaaacttcccagctaatggtcccgttatgcagaaaaagactgctggctgggagccttgtgtcgaaatgctgtacccccgagacggtgtcttgtgtggtcaatctttgatggctttgaaatgtacagatggtaatcacctgacaagtcatcttagaacaacttaccgttccagaaagccatctaatgcagtgaacatgccagaatttcactttggtgaccataggattgagattctcaaggccgaaagaggtaaattctatgagcaatacgagtcagctgttgctaggtatagcgatgttccagaaaaagctactgattacaaggatgatgacgataagggcgctggcactagttacgctggatattttgccgatttgctcatccatgacattgaaactaacccaggtcctatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagattaggaagaacaacaagagacgatctgataaatggaaattctgcctcctgtgctgatgttatatttatatatgcccgaggctctacagaaactggcaatttgggaactttgggcccatctattgcttctaaccttgaatctgcttttggtaaggatggagtttggattcagggcgtgggtggagcctatgctgccactttgggtgacaatgctttgccaagaggtacatcctcagccgctattcgtgagatgttaggtttatttcagcaggctaacactaagtgtcccgatgcaacattgattgcaggtggatattctcaaggtgccgccttggccgccgcttctattgaagaccttgatagtgcaataagggacaagattgcaggtacagttttgtttggttacaccaagaatctacaaaacagaggtcgaatccccaattacccagctgacagaacgaaggtcttttgtaatacaggcgaccttgtgtgtaccggatctttgatagtcgctgctccccatttggcttacggaccagatgctagaggtccagcacccgaattcttgattgagaaagtacgtgctgttagaggttcagcccatcatcatcatcaccattga

SEQ ID NO: 207 - protein, 551 aa, Pichia pastoris
MASLVKKDMCIKMTMEGTVNGYHFKCVGEGEGKPFEGTQNTRIRVTEGGPLPFAFDILAPCCMYGSKTFIKHVSGIPDYFKESFPEGFTWERTQIFEDGGVLTAHQDTSLEGNCLIYKVKVLGTNFPANGPVMQKKTAGWEPCVEMLYPRDGVLCGQSLMALKCTDGNHLTSHLRTTYRSRKPSNAVNMPEFHFGDHRIEILKAERGKFYEQYESAVARYSDVPEKATDYKDDDDKGAGTSYAGYFADLLIHDIETNPGPMRFPSIFTAVLFAASSALAAPVNTTTEDETAQIPAEAVIGYSDLEGDFDVAVLPFSNSTNNGLLFINTTIASIAAKEEGVSLEKRLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSAHHHHHH

SEQ ID NO: 208 - DNA, 1692 bp, Pichia pastoris
gaattcaaaacgatgactgccctgactgaaggcgcaaaactgttcgagaaagagattccttatatcactgaattggaaggtgacgttgagggtatgaaattcatcatcaaaggtgaaggtacaggagatgcttcagttggaaaggtggatgctcagtttatctgcacaacgggagacgtcccagtgccatggagcaccttggttaccacactaacttatggcgcacaatgttttgccaaatacccaagacatatcgcagactttttcaaatcctgtatgccggaaggttacgttcaagagcgtacaattacatttgagggtgatggtgttttcaagacaagagctgaggtgactttcgaaaatggaagtgtctataacagagtgaaactgaatggtcaaggttttaagaaagatggacatgtattgggaaagaatttggagttcaactttactccacactgtctttacatctggggtgaccaagctaatcatggattgaaatccgcttttaagataatgcacgaaattacaggttcgaaggaagatttcattgtggcagaccatactcagatgaacacccctattggcggtggtcctgttcacgttcccgaataccatcacatcacgtaccatgtaactctttctaaggacgttaccgatcaccgtgaccatctcaatatagtcgaggtcattaaggctgttgacttagagacttatagggattacaaggatgatgacgataagggcgctggcactagttacgctggatattttgccgatttgctcatccatgacattgaaactaacccaggtcctatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagattaggaagaacaacaagagacgatctgataaatggaaattctgcctcctgtgctgatgttatatttatatatgcccgaggctctacagaaactggcaatttgggaactttgggcccatctattgcttctaaccttgaatctgcttttggtaaggatggagtttggattcagggcgtgggtggagcctatgctgccactttgggtgacaatgctttgccaagaggtacatcctcagccgctattcgtgagatgttaggtttatttcagcaggctaacactaagtgtcccgatgcaacattgattgcaggtggatattctcaaggtgccgccttggccgccgcttctattgaagaccttgatagtgcaataagggacaagattgcaggtacagttttgtttggttacaccaagaatctacaaaacagaggtcgaatccccaattacccagctgacagaacgaaggtcttttgtaatacaggcgaccttgtgtgtaccggatctttgatagtcgctgctccccatttggcttacggaccagatgctagaggtccagcacccgaattcttgattgagaaagtacgtgctgttagaggttcagcccatcatcatcatcaccattga

SEQ ID NO: 209 - protein, 563 aa, Pichia pastoris
EFKTMTALTEGAKLFEKEIPYITELEGDVEGMKFIIKGEGTGDASVGKVDAQFICTTGDVPVPWSTLVTTLTYGAQCFAKYPRHIADFFKSCMPEGYVQERTITFEGDGVFKTRAEVTFENGSVYNRVKLNGQGFKKDGHVLGKNLEFNFTPHCLYIWGDQANHGLKSAFKIMHEITGSKEDFIVADHTQMNTPIGGGPVHVPEYHHITYHVTLSKDVTDHRDHLNIVEVIKAVDLETYRDYKDDDDKGAGTSYAGYFADLLIHDIETNPGPMRFPSIFTAVLFAASSALAAPVNTTTEDETAQIPAEAVIGYSDLEGDFDVAVLPFSNSTNNGLLFINTTIASIAAKEEGVSLEKRLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSAHHHHHH

SEQ ID NO: 210 - DNA, 1680 bp, Pichia pastoris
atgaccgcactaacagaaggagctaaactattcgaaaaggagattccttacattacagaattagagggtgatgtcgaaggaatgaaattcattatcaagggcgagggtactggtgacgctactaccggtacgattaaagcaaagtacatctgtacaacaggtgaccttcctgttccgtgggctactctggtgagcactttgtcttatggagttcaatgttttgctaaatacccttcgcacattaaagactttttcaaaagtgcaatgcctgagggctatactcaggagagaacaatatctttcgaaggagatggtgtgtataagactagggctatggtcacgtatgaaagaggatccatctacaatagagtaactttaactggtgaaaacttcaaaaaggacggtcacatccttagaaagaatgttgcctttcaatgcccaccatccatcttgtacattttgccagacacagttaacaatggtatcagagttgagtttaaccaagcttatgacatagagggtgtcaccgaaaagttggttacaaaatgttcacagatgaatcgtcccctggcaggatcagctgccgtccatatcccacgttaccatcatatcacttatcataccaagctgtccaaagatcgtgatgagagaagggatcacatgtgtttggttgaagtggtaaaggccgtggatttggatacttaccaagattacaaggatgatgacgataagggcgctggcactagttacgctggatattttgccgatttgctcatccatgacattgaaactaacccaggtcctatgagatttccttcaatttttactgctgttttattcgcagcatcctccgcattagctgctccagtcaacactacaacagaagatgaaacggcacaaattccggctgaagctgtcatcggttactcagatttagaaggggatttcgatgttgctgttttgccattttccaacagcacaaataacgggttattgtttataaatactactattgccagcattgctgctaaagaagaaggggtatctctcgagaaaagattaggaagaacaacaagagacgatctgataaatggaaattctgcctcctgtgctgatgttatatttatatatgcccgaggctctacagaaactggcaatttgggaactttgggcccatctattgcttctaaccttgaatctgcttttggtaaggatggagtttggattcagggcgtgggtggagcctatgctgccactttgggtgacaatgctttgccaagaggtacatcctcagccgctattcgtgagatgttaggtttatttcagcaggctaacactaagtgtcccgatgcaacattgattgcaggtggatattctcaaggtgccgccttggccgccgcttctattgaagaccttgatagtgcaataagggacaagattgcaggtacagttttgtttggttacaccaagaatctacaaaacagaggtcgaatccccaattacccagctgacagaacgaaggtcttttgtaatacaggcgaccttgtgtgtaccggatctttgatagtcgctgctccccatttggcttacggaccagatgctagaggtccagcacccgaattcttgattgagaaagtacgtgctgttagaggttcagcccatcatcatcatcaccattga

SEQ ID NO: 211 - protein, 559 aa, Pichia pastoris
MTALTEGAKLFEKEIPYITELEGDVEGMKFIIKGEGTGDATTGTIKAKYICTTGDLPVPWATLVSTLSYGVQCFAKYPSHIKDFFKSAMPEGYTQERTISFEGDGVYKTRAMVTYERGSIYNRVTLTGENFKKDGHILRKNVAFQCPPSILYILPDTVNNGIRVEFNQAYDIEGVTEKLVTKCSQMNRPLAGSAAVHIPRYHHITYHTKLSKDRDERRDHMCLVEVVKAVDLDTYQDYKDDDDKGAGTSYAGYFADLLIHDIETNPGPMRFPSIFTAVLFAASSALAAPVNTTTEDETAQIPAEAVIGYSDLEGDFDVAVLPFSNSTNNGLLFINTTIASIAAKEEGVSLEKRLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSAHHHHHH

SEQ ID NO: 212 - DNA, 684 bp, Pichia pastoris; identical to SEQ ID NO: 188

SEQ ID NO: 213 - protein, 226 aa, Pichia pastoris; identical to SEQ ID NO: 189

SEQ ID NO: 214 - DNA, 681 bp, Pichia pastoris
atgtccctttccaaacaagttttgcctcatgatgtgaaaatgagataccatatggatggatgtgttaacggtcacagtttcactattgagggagaaggtgctggtaaaccttatgaaggcaaaaagatcttggaactgcgtgtaacaaagggaggaccacttccattcgcctttgacattttgtccagcgttttcacttatggtaacaggtgtttctgtgagtatccagaggatatgcccgactactttaagcaatcattgcccgagggtcactcttgggagagaactttaatgtttgaggatggaggatgcggtactgcttcagcccatatatcgttggacaaaaactgtttcgtgcataagtctacgtttcatggtgtgaattttcctgctaatggtccggtcatgcagaaaaaggcaatgaattgggagcctagctctgaactgatcaccgcatgtgatggtattctcaaaggcgacgttaccatgtttttgttgctggaaggtggtcacagattaaagtgccaattcacaacatcctacaaggctcataaagcagtgaagatgccaccaaatcacattatcgagcatgtcctagtcaaaaaggaagttgctgacggttttcaaatccaggaacacgctgttgcaaaacacttcacagtagatgttaaggaaacttag

SEQ ID NO: 215 - protein, 226 aa, Pichia pastoris; identical to SEQ ID NO: 95

SEQ ID NO: 216 - DNA, 681 bp, Pichia pastoris
atgtcactttctaaacaagttttacctagagatgttaagatgagatatcatatggatggttgcgtaaacggtcatcaattcattattgagggtgaaggaacgggtaagcctgatgagggtaaaaagatcttggaactgagagtcactaaaggaggaccattgccatttgccttcgacatcttgtcatccgtgtttacttacggtaatcgttgtttttgtgaatatccagaggaaatgcctgactactttaaacaatctttaccagaaggacactcgtgggagaggaccatgatgttcgaagatggtggttgttctacttccagtgctcacattagacttgaaaaggactgtttcatccataactccacattccacggcgtgaatttccccgctaatggtcctgttatgcagaaaaagacattgaactgggagccctcaagtgagttgatcactgcaggagatggtatactgaagggcgacgttaccatgtttctgatgctagagggaggtcatcgtttgaaatgccaatttacaacgagctacaaagctaaaaaggcagtgaagatgccaccaaatcacattatcgaacatgtcctcgtgaaaaaggaagtcgctgatggtttccaaattcaggaacacgcagtagctaagcattttacagttgacgttaaagagacttag

SEQ ID NO: 217 - protein, 226 aa, Pichia pastoris
MSLSKQVLPRDVKMRYHMDGCVNGHQFIIEGEGTGKPDEGKKILELRVTKGGPLPFAFDILSSVFTYGNRCFCEYPEEMPDYFKQSLPEGHSWERTMMFEDGGCSTSSAHIRLEKDCFIHNSTFHGVNFPANGPVMQKKTLNWEPSSELITAGDGILKGDVTMFLMLEGGHRLKCQFTTSYKAKKAVKMPPNHIIEHVLVKKEVADGFQIQEHAVAKHFTVDVKET

SEQ ID NO: 218 - DNA, 681 bp, Pichia pastoris
atgtcattgtccaaacaagtattgcctagagatgtgagaatgagatttcacatggatggttgtgttaacggacatcaattcacaattgaaggcgagggtgccggtaagccatacgaaggtaaaaagatcttggaattgagagttacgaaaggtggaccattaccattcgcatttgacattctgtcgtctactttcacatatggcaatcgttgtttctgcgattatcccgaggagatgcctgactatttcaaacagagccttcccgagggatacagttgggaaaggacattaatgtttgaggatggtggttgtggaactgcttccgctcatatccgtctagagaaggattgttttgtgcaccaatctactttccacggagttaacttccctgcaaatggaccggtcatgcagaaaaagactctgaattgggaaccttccagcgagcttattaccgcttgtgatggtatcttgaaaggtgacgttaccatgtttttgttgctggaaggtggtcatagacttaagtgccaatttacaacttcatacaaagctcacaaggccgtcaaaataccaccaaatcatatcattgaacatgtcctggtgaaaaaggaagtagctgacggttttcagatccaagagcatgcagttgctaagcacttcactgtggacgttaaggaaacatag

SEQ ID NO: 219 - protein, 226 aa, Pichia pastoris; identical to SEQ ID NO: 93

SEQ ID NO: 220 - DNA, 1649 bp, Pichia pastoris
atggccagcttagtgaaaaaggatatgtgcatcaaaatgacgatggaaggaactgtgaacggtcatcactttaagtgtgtcggtgaaggtgagggtaagcctttcgagggtacacagaatatgagaattagagtaactgaaggcgctcctttgccttttgcttttgatatcctgtccccatgttgcgcatatggaagtaagacgttcattaaacatgtttccggaataccagactacttcaaggagagctttccagaaggttttacttgggagcgtaccacaatttacgaagatggaggtgtccttactgcacatcaagacacttcactcgagggtaattgtttgatctacaaggttaaagtcctgggcactaacttccccgctgacggtccagttatgaaaaagatttctggtggttgggagccttgtgtggaaatgctatatcctagagacggtgttttgtgtggacaatctttgatggctttgaaatgtacagatggtaatcatttgacatcacaccttagaacaacctatcgtagtaggaaaccatctaatgccgttaacatgccagaatttcatttcggtgatcacagaatcgagatcttaaaagctgaacagggaaaattctacgaacaatacgagtccgcagtagctcgatattgcgaggctgcaccctcgaagctaggacaccatggcactagtgagggcagaggaagtctgctaacatgcggtgacgtcgaggagaatcctggcccaatgagattcccatctattttcaccgctgtcttgttcgctgcctcctctgcattggctgcccctgttaacactaccactgaagatgagactgctcaaattccagctgaagcagttatcggttactctgaccttgagggtgatttcgacgtcgctgttttgcctttctctaactccactaacaacggtttgttgttcattaacaccactatcgcttccattgctgctaaggaagagggtgtctctctcgagaaaagagaggccgaagctagtcctgttgatttgcaagatagacaattgaccggcggagatgagctaagggatggaccttgtaagcctattactttcatctttgctcgtgcttctactgaacctggcctacttggtataagtacaggacctgctgtatgtaaccgtttgaagctggccagatctggtgacgtagcatgtcagggcgtaggaccacgttacacagcagatctaccttcaaatgctttgccagaggggacttcccaagctgccatcgccgaggcacagggtctattcgaacaggcagtcagtaaatgcccagacactcagatcgtggctggtggttattcacagggaacggccgtgatgaatggggctattaaaagattgagtgcagatgttcaagataaaataaagggtgttgtattgttcggatatactaggaacgcccaggaacgaggacagattgcaaacttccctaaggataaagtaaaggtttactgtgccgtgggtgatcttgtttgtcttggaacattaattgtggctccacctcatttcagttatttgtctgacaccggagatgcctcagattttctgttatctcaactaggacatcatcatcatcaccattgataaggggcggccgc

SEQ ID NO: 221 - protein, 544 aa, Pichia pastoris
MASLVKKDMCIKMTMEGTVNGHHFKCVGEGEGKPFEGTQNMRIRVTEGAPLPFAFDILSPCCAYGSKTFIKHVSGIPDYFKESFPEGFTWERTTIYEDGGVLTAHQDTSLEGNCLIYKVKVLGTNFPADGPVMKKISGGWEPCVEMLYPRDGVLCGQSLMALKCTDGNHLTSHLRTTYRSRKPSNAVNMPEFHFGDHRIEILKAEQGKFYEQYESAVARYCEAAPSKLGHHGTSEGRGSLLTCGDVEENPGPMRFPSIFTAVLFAASSALAAPVNTTTEDETAQIPAEAVIGYSDLEGDFDVAVLPFSNSTNNGLLFINTTIASIAAKEEGVSLEKREAEASPVDLQDRQLTGGDELRDGPCKPITFIFARASTEPGLLGISTGPAVCNRLKLARSGDVACQGVGPRYTADLPSNALPEGTSQAAIAEAQGLFEQAVSKCPDTQIVAGGYSQGTAVMNGAIKRLSADVQDKIKGVVLFGYTRNAQERGQIANFPKDKVKVYCAVGDLVCLGTLIVAPPHFSYLSDTGDASDFLLSQLGHHHHHH

SEQ ID NO: 222 - DNA, 1382 bp, Pichia pastoris
atggccagcttagtgaaaaaggatatgtgcatcaaaatgacgatggaaggaactgtgaacggtcatcactttaagtgtgtcggtgaaggtgagggtaagcctttcgagggtacacagaatatgagaattagagtaactgaaggcgctcctttgccttttgcttttgatatcctgtccccatgttgcgcatatggaagtaagacgttcattaaacatgtttccggaataccagactacttcaaggagagctttccagaaggttttacttgggagcgtaccacaatttacgaagatggaggtgtccttactgcacatcaagacacttcactcgagggtaattgtttgatctacaaggttaaagtcctgggcactaacttccccgctgacggtccagttatgaaaaagatttctggtggttgggagccttgtgtggaaatgctatatcctagagacggtgttttgtgtggacaatctttgatggctttgaaatgtacagatggtaatcatttgacatcacaccttagaacaacctatcgtagtaggaaaccatctaatgccgttaacatgccagaatttcatttcggtgatcacagaatcgagatcttaaaagctgaacagggaaaattctacgaacaatacgagtccgcagtagctcgatattgcgaggctgcaccctcgaagctaggacaccatggcactagtgagggcagaggaagtctgctaacatgcggtgacgtcgaggaaaatcctggcccaagtcctgttgatttgcaagatagacaattgaccggcggagatgagctaagggatggaccttgtaagcctattactttcatctttgctcgtgcttctactgaacctggcctacttggtataagtacaggacctgctgtatgtaaccgtttgaagctggccagatctggtgacgtagcatgtcagggcgtaggaccacgttacacagcagatctaccttcaaatgctttgccagaggggacttcccaagctgccatcgccgaggcacagggtctattcgaacaggcagtcagtaaatgcccagacactcagatcgtggctggtggttattcacagggaacggccgtgatgaatggggctattaaaagattgagtgcagatgttcaagataaaataaagggtgttgtattgttcggatatactaggaacgcccaggaacgaggacagattgcaaacttccctaaggataaagtaaaggtttactgtgccgtgggtgatcttgtttgtcttggaacattaattgtggctccacctcatttcagttatttgtctgacaccggagatgcctcagattttctgttatctcaactaggacatcatcatcatcaccattgataaggggcggccgc

SEQ ID NO: 223 - protein, 455 aa, Pichia pastoris
MASLVKKDMCIKMTMEGTVNGHHFKCVGEGEGKPFEGTQNMRIRVTEGAPLPFAFDILSPCCAYGSKTFIKHVSGIPDYFKESFPEGFTWERTTIYEDGGVLTAHQDTSLEGNCLIYKVKVLGTNFPADGPVMKKISGGWEPCVEMLYPRDGVLCGQSLMALKCTDGNHLTSHLRTTYRSRKPSNAVNMPEFHFGDHRIEILKAEQGKFYEQYESAVARYCEAAPSKLGHHGTSEGRGSLLTCGDVEENPGPSPVDLQDRQLTGGDELRDGPCKPITFIFARASTEPGLLGISTGPAVCNRLKLARSGDVACQGVGPRYTADLPSNALPEGTSQAAIAEAQGLFEQAVSKCPDTQIVAGGYSQGTAVMNGAIKRLSADVQDKIKGVVLFGYTRNAQERGQIANFPKDKVKVYCAVGDLVCLGTLIVAPPHFSYLSDTGDASDFLLSQLGHHHHHH

SEQ ID NO: 224 - DNA, 713 bp, Pichia pastoris
atggctagcttagtgaaaaaggatatgtgcatcaaaatgacgatggaaggaactgtgaacggtcatcactttaagtgtgtcggtgaaggtgagggtaagcctttcgagggtacacagaatatgagaattagagtaactgaaggcgctcctttgccttttgcttttgatatcctgtccccatgttgcgcatatggaagtaagacgttcattaaacatgtttccggaataccagactacttcaaggagagctttccagaaggttttacttgggagcgtaccacaatttacgaagatggaggtgtccttactgcacatcaagacacttcactcgagggtaattgtttgatctacaaggttaaagtcctgggcactaacttccccgctgacggtccagttatgaaaaagatttctggtggttgggagccttgtgtggaaatgctatatcctagagacggtgttttgtgtggacaatctttgatggctttgaaatgtacagatggtaatcatttgacatcacaccttagaacaacctatcgtagtaggaaaccatctaatgccgttaacatgccagaatttcatttcggtgatcacagaatcgagatcttaaaagctgaacagggaaaattctacgaacaatacgagtccgcagtagctcgatattgcgaggctgcaccctcgaagctaggacaccattgaactagtggtctcagggg

SEQ ID NO: 225 - protein, 231 aa, Pichia pastoris; identical to SEQ ID NO: 4

SEQ ID NO: 226 - DNA, 656 bp, Pichia pastoris
aaaaggagacctgctagcttaggaagaacaacaagagacgatctgataaatggaaattctgcctcctgtgctgatgttatatttatatatgcccgaggctctacagaaactggcaatttgggaactttgggcccatctattgcttctaaccttgaatctgcttttggtaaggatggagtttggattcagggcgtgggtggagcctatgctgccactttgggtgacaatgctttgccaagaggtacatcctcagccgctattcgtgagatgttaggtttatttcagcaggctaacactaagtgtcccgatgcaacattgattgcaggtggatattctcaaggtgccgccttggccgccgcttctattgaagaccttgatagtgcaataagggacaagattgcaggtacagttttgtttggttacaccaagaatctacaaaacagaggtcgaatccccaattacccagctgacagaacgaaggtcttttgtaatacaggcgaccttgtgtgtaccggatctttgatagtcgctgctccccatttggcttacggaccagatgctagaggtccagcacccgaattcttgattgagaaagtacgtgctgttagaggttcagcccatcatcatcatcaccattgaactagtggtctcagggg

SEQ ID NO: 227 - protein, 212 aa, Pichia pastoris
KRRPASLGRTTRDDLINGNSASCADVIFIYARGSTETGNLGTLGPSIASNLESAFGKDGVWIQGVGGAYAATLGDNALPRGTSSAAIREMLGLFQQANTKCPDATLIAGGYSQGAALAAASIEDLDSAIRDKIAGTVLFGYTKNLQNRGRIPNYPADRTKVFCNTGDLVCTGSLIVAAPHLAYGPDARGPAPEFLIEKVRAVRGSAHHHHHH

SEQ ID NO: 228 - DNA, 711 bp, Escherichia coli
atgacggcattgacggagggagccaagttgttcgagaaagagattccgtacattacagagctggagggcgacgtcgagggcatgaagttcatcatcaagggggagggaacaggggacgccacgacaggcactatcaaagcgaaatacatctgcactacgggggatctgcccgtgccttgggcgacgctggtgtcaacgctgtcgtatggagtccagtgcttcgccaagtacccctcacacatcaaggacttcttcaagtcggcaatgccggaggggtacacacaagagcgcaccattagctttgaaggcgacggggtgtacaaaacacgggccatggtgacatacgagagggggagcatatacaacagagtgaccctgaccggggaaaactttaagaaggacgggcacatcctgcggaagaacgtggctttccagtgcccaccctccatactgtacatcctgccggacaccgtgaacaatgggattagggtggagttcaaccaggcatatgatatagaaggcgtgaccgagaagctggtgactaagtgcagccagatgaataggcctctggctgggtctgcggcggtccacatcccaaggtatcaccacatcacgtaccacaccaagttgtccaaggatcgggacgagagacgggaccatatgtgtttggtggaggtggtgaaggccgtggacctggacacctaccagtga

SEQ ID NO: 229 - DNA, 714 bp, Escherichia coli
atgactgctcttaccgaaggcgccaaactgtttgaaaaagaaattccatacatcaccgaacttgaaggcgacgtggagggtatgaagtttatcattaagggagaagggactggggacgctacaacaggtaccatcaaggccaaatacatctgcacaacgggcgacctccccgtcccgtgggctaccctggtgagcaccctgagctatggcgtccagtgctttgctaagtacccgtcccatatcaaggacttcttcaaatctgccatgcctgaaggttatacacaagaacgcactatatcttttgagggcgatggagtgtataagacacgggctatggtgacgtacgaacgcggaagtatctacaatcgcgtgacgctgaccggggaaaactttaagaaagatggtcacatcctccggaagaatgtggcttttcagtgtccgccctctatactttacatccttcccgacactgtcaacaatggcattcgcgtggagttcaatcaggcctacgacatagaaggagttaccgagaagcttgtcacgaagtgtagtcagatgaatcgccctcttgctgggagtgcagctgtccatattccacgctaccatcacattacctatcatacaaaactttccaaggatagggatgagaggcgcgaccatatgtgcctcgttgaagtcgttaaggcagtggatctcgacacataccaatgataa

SEQ ID NO: 230 - DNA, 714 bp, Escherichia coli
atgactgcactcacagagggtgccaagctgttcgaaaaggagatcccatacattactgaactggagggagatgttgagggtatgaagttcattatcaagggtgaaggaacaggcgatgcgacaaccggcaccatcaaggcaaagtacatttgcactaccggggatctgccagtgccatgggccactttggtgtccactctgagctacggtgtgcagtgtttcgctaagtacccctcccatatcaaagactttttcaagagcgcaatgccagaagggtatactcaagagcgaactatttcctttgagggagacggtgtgtacaaaactcgcgctatggtcacttatgagagaggcagcatctacaatagagtaacactgaccggagagaactttaagaaagatggccatattctgcgtaagaatgtagcatttcagtgtccaccatccatcctgtacatcctccccgatactgtgaacaacggtatacgcgtggagtttaaccaggcctatgatattgaaggtgtgactgagaagttggtgactaagtgcagccagatgaaccggcctttggccggctccgcggctgttcacatacctcgttatcatcacattacataccataccaagctgagcaaagatagggatgagcgtcgggatcatatgtgcctcgtggaagtcgtgaaggcagtcgacctggacacctaccagtgataa

SEQ ID NO: 231 - DNA, 714 bp, Escherichia coli
atgactgcgcttaccgagggggccaaactgttcgaaaaagaaattccgtacattaccgagttggagggcgacgtggagggtatgaagttcattatcaaaggggagggcaccggggacgctaccactggaaccattaaggccaagtatatctgcacaaccggcgaccttccagtgccatgggccaccctcgtgagcaccctgtcttacggcgtccagtgttttgcgaagtatcctagtcacattaaggacttcttcaaatcagcaatgcctgaggggtatacacaagagcgaaccatttctttcgaaggcgacggggtctacaagaccagagcaatggttacatatgagcgcggatcaatctataaccgcgttactttgaccggcgagaatttcaaaaaggacggtcatattctgagaaagaatgtcgcatttcagtgtcctccatcaattctctacattcttcccgataccgtcaacaatggcattagagtggaattcaatcaggcctatgacatcgagggcgtgaccgagaagctggtgaccaagtgtagccagatgaataggcccctggccggatccgctgcggtgcacattccacgatatcatcatatcacctatcataccaagctgtcaaaagaccgggacgaaaggcgggatcatatgtgtctcgtggaagtcgttaaggcggtcgatctcgacacctatcaatgataa

SEQ ID NO: 232 - DNA, 714 bp, Escherichia coli
atgacagctctgaccgagggcgcgaaactcttcgagaaagagattccttacatcacagagctggaaggggatgttgaagggatgaagttcattatcaagggtgagggcaccggagatgcaacaacagggaccataaaggccaaatacatctgcacaactggggatctcccggtcccgtgggccactcttgtttctactctcagttatggggttcagtgctttgctaagtacccaagccacatcaaggactttttcaaaagtgccatgcctgaaggatacacccaagagagaacaatttcctttgaaggagatggagtctacaagactagagcaatggttacatatgaacggggctccatctacaatagggtgacactgacaggcgagaactttaagaaggatggtcacatcctccggaagaacgttgcttttcagtgtccaccctctatactttacattcttcccgacacagtgaataacggcattcgggtagagttcaatcaagcatacgatattgagggcgtcacagagaagcttgtgacaaaatgcagccagatgaataggcccctggcagggtctgctgccgttcacatcccgaggtaccatcacattacatatcacacaaagctttcaaaggaccgggatgagcgcagggaccacatgtgccttgtggaagtagttaaagcagttgatcttgatacataccaatgataa

SEQ ID NO: 233 - DNA, 714 bp, Escherichia coli
atgactgctcttactgaaggagccaaactgtttgaaaaggaaattccctatatcaccgaattggaaggggatgtggaggggatgaaattcatcatcaagggcgaaggaaccggtgacgccacaacagggactatcaaggctaagtatatctgcaccaccggcgatctgccagtgccttgggccactctcgtgtccaccctttcctacggggtccagtgttttgccaagtatccaagccacattaaggacttcttcaaatccgctatgccggaaggctatacacaagagaggaccatttcctttgagggcgacggtgtgtataagacacgggcaatggtgacatacgaaagaggcagcatctacaaccgggtgacactgactggagaaaacttcaagaaagatggacacatacttcgcaagaacgtggcttttcagtgtccaccaagcattttgtacatactccctgatactgtgaacaatgggataagagtcgagtttaaccaggcatatgacattgagggcgtcacagaaaagctcgtgaccaagtgtagccagatgaatcgccctctggccgggtccgcagccgtgcacatcccccgatatcaccacatcacttatcacactaagctcagcaaggacagagatgaaaggcgagatcatatgtgtcttgtggaagtggtgaaggctgtggatctggacacctatcagtgataa

SEQ ID NO: 234 - DNA, 714 bp, Escherichia coli
atgaccgcactcaccgagggggctaaactgtttgagaaagagattccctatatcaccgagctggagggtgatgttgagggcatgaagtttatcatcaagggcgaaggaaccggcgacgcaaccaccggaaccatcaaggccaagtacatctgcaccaccggagatctgcctgtcccttgggccaccctggtgtctactttgtcttacggagttcaatgctttgccaagtatccaagtcacatcaaggacttctttaagagtgctatgcctgagggatatacccaagagcgcaccatctcctttgagggagacggagtgtacaaaacccgggcaatggtcacttatgagcgtggaagcatatacaatcgagttacactgaccggagagaatttcaagaaggatggacatatcctgagaaagaacgttgcatttcaatgtcccccatccatactgtacattctcccagacaccgttaacaatgggattagggtcgagttcaatcaggcatacgacatagaaggtgtgacagagaaactggtaactaaatgtagccagatgaacagaccgttggctgggtcagcagcagttcacattccacgctatcaccacattacctatcacacaaagctctctaaggacagggacgagagacgggaccacatgtgtctggtcgaagttgttaaagcagtggacttggacacctatcagtgataa

SEQ ID NO: 235 - DNA, 714 bp, Escherichia coli
atgactgctttgacagaaggggccaaactctttgagaaagaaatcccttacatcactgaactggaaggcgatgtcgaagggatgaaattcatcatcaaaggcgaaggcactggcgacgccacaacaggcaccataaaggccaagtatatctgcaccaccggcgacctgcctgtgccatgggccaccctggtgagcactctctcctacggtgtgcaatgcttcgccaaataccccagtcacattaaggacttcttcaagtctgccatgccagaaggctatacccaagagcgaactatttcatttgaaggggatggtgtatacaagacaagagctatggtcacttatgagagaggcagtatctacaatagagtgaccctgaccggcgaaaacttcaagaaggatgggcacattttgcgaaagaatgttgctttccagtgcccaccatctatactgtacattctcccagacacagttaacaatggcatcagagttgagtttaaccaggcctacgacatagaaggcgtgactgaaaaactggtcaccaagtgcagccagatgaatcggccattggcaggctccgcagctgttcatatcccccgataccatcatatcacttaccatacaaagctgtcaaaggatagggatgaacggagagatcatatgtgtctggtggaggttgtcaaggccgtagatctggacacataccagtgataa

SEQ ID NO: 236 - DNA, 714 bp, Escherichia coli
atgaccgcattgaccgaaggcgccaagctgttcgaaaaagaaattccctacattacggaactggagggagacgtcgagggtatgaagttcatcattaagggagaagggaccggagacgccacaacaggcaccatcaaagctaagtatatctgcacaacgggtgatttgcctgttccgtgggccactttggtgtccacgctgtcatatggagtgcagtgttttgcaaagtatcccagccacattaaggactttttcaagtcagctatgcccgagggatacacacaagagcgcactatttctttcgagggggacggggtctacaaaactcgggctatggtgacttacgaacggggcagcatctataaccgggtcacactgacaggagaaaactttaagaaggatggacacattctgcgcaagaatgtcgccttccagtgtccaccgtcaattctgtacattctgccagatacagtcaataacggaattcgcgtggagttcaatcaggcttatgacattgagggagtgacagaaaaactggtgaccaagtgcagtcagatgaataggccactggccggatctgccgccgtccacattcctagatatcaccacatcacataccatactaagctgtcaaaagatcgcgacgaaagaagggatcacatgtgtctggttgaggtcgtcaaagccgtcgatttggatacctatcagtgataa

SEQ ID NO: 237 - DNA, 714 bp, Escherichia coli
atgacagctcttactgagggagcaaagcttttcgagaaggagataccctatatcacagaactcgagggcgacgtggaggggatgaagttcatcatcaaaggagagggaactggggacgccacaaccgggacaatcaaggccaagtacatttgtacaactggcgatcttcctgttccatgggcgacactggtttctacactttcctatggcgttcagtgtttcgccaagtatccaagccatatcaaggatttcttcaaatcagcaatgccggagggttatacacaagagcgcacaatctcatttgagggcgatggcgtgtacaagaccagagccatggtaacctacgagaggggttccatctacaacagggtgacactgacaggcgaaaactttaagaaagatggtcatatactccgcaagaatgtcgccttccagtgcccgccatctatcctttacattcttcctgatacagtgaacaatggtataagagtagagtttaaccaagcttatgatatcgagggagtgacagagaagctcgtcactaagtgtagccagatgaatcggccccttgccggaagcgcggcagtacatattccccggtatcaccacattacctatcatacaaagctcagtaaggatcgggacgagcgccgcgaccatatgtgcctggtggaagtcgtgaaagctgtggatctggatacataccagtgataa

SEQ ID NO: 238 - DNA, 714 bp, Escherichia coli
atgacggcactgaccgaaggcgctaagttgtttgagaaggaaataccctacataacagagttggaaggcgacgtggagggcatgaagttcattatcaagggcgaggggacaggtgacgctaccacgggtaccatcaaagccaagtatatctgtaccactggcgacttgcctgtaccatgggccacactggtgagcaccctgagctatggggttcagtgttttgctaagtacccatcccatatcaaggatttctttaagtccgctatgccagagggctatacccaagaaagaacgatttcttttgaaggggacggcgtgtacaaaacaagagctatggttacatacgaacggggcagtatctataaccgcgtgactctgacaggcgagaactttaagaaagatggccatattctgcggaagaatgtagcctttcaatgtcccccttccatcttgtatatcctgcccgataccgtcaacaatggcattagggtcgaattcaaccaggcttatgacattgagggcgtaaccgaaaaactggtcactaagtgcagccagatgaatcggccgctggctggtagcgctgccgtgcatattccgcgctatcatcacattacatatcacacgaagctgtctaaggaccgggatgaaaggagggaccatatgtgtctggtggaggttgtgaaggcagtggacctggatacttatcagtgataa

SEQ ID NO: 239 - DNA, 714 bp, Escherichia coli
atgaccgccttgaccgaaggagccaagttgtttgagaaggagatcccctacattacagaacttgagggagacgtggagggtatgaaattcatcattaagggggagggaactggcgatgccacaaccggaactatcaaggccaaatacatttgtaccaccggggacctgccagttccatgggctactctggtatcaacgctctcctatggggtgcagtgtttcgccaaatacccttctcacattaaggacttctttaagagtgccatgcctgaaggctacactcaagagcggaccattagcttcgaaggcgacggcgtctacaagactcgcgccatggtaacatacgaacgtggttctatctacaatagggtaacacttaccggagagaacttcaagaaggacggccacattctgagaaagaacgtggccttccagtgcccaccatcaattctctacatccttccagacacagttaacaatggtattcgtgtggaattcaaccaagcctatgatattgagggagtgaccgaaaaactggtgaccaagtgcagccagatgaatcgaccactcgccgggtccgccgctgtacatattccccgctatcaccacattacctatcacaccaagctgagcaaggaccgggatgaaagacgtgatcacatgtgcctggttgaagtggtaaaggccgtcgatctcgacacgtaccaatgataa

SEQ ID NO: 240 - DNA, 714 bp, Escherichia coli
atgacagccttgacggagggcgctaagctgtttgagaaagagatcccatacatcacagagctcgagggtgatgtggagggcatgaaattcattatcaaaggcgagggtacaggcgacgccacgaccggcacgattaaggccaagtacatttgcaccactggcgacctgcctgttccatgggccacacttgttagtactctctcctatggcgtacagtgctttgccaagtacccatcacacatcaaagactttttcaaatcagccatgcccgaggggtatactcaagaacggacaataagttttgagggcgacggcgtctacaaaacccgcgccatggtgacttatgagcgcggctctatctataaccgggtcacactgacaggggagaacttcaagaaagacggccatatcctgcgcaaaaacgtagcctttcagtgtcctccttctatcctctacattctgcccgacaccgtgaacaacggcatcagggtggagttcaatcaggcctatgatatagaaggcgtgaccgaaaagttggtgactaagtgcagccagatgaataggccgcttgctgggtccgctgccgtgcacattccacgctaccaccatatcacatatcacacaaaactgagcaaagatcgcgacgagcgccgggaccacatgtgcctcgttgaggtagtcaaggccgtggacctcgacacctatcagtgataa

SEQ ID NO: 241 - DNA, 714 bp, Escherichia coli
atgactgcactgacagagggcgccaaactcttcgagaaagaaattccttacatcacagaactcgaaggtgacgtggagggtatgaagtttatcatcaaaggagagggaacaggggacgcaacaacagggacaatcaaagctaagtatatctgtacaactggcgacctaccggtcccttgggcaacactggtttccacacttagttatggggtccagtgcttcgccaagtatccatctcacatcaaagatttcttcaaatccgcaatgcctgaaggatatactcaagaacggacaatcagcttcgaaggagatggcgtttacaagaccagggctatggttacatatgaacgcggatctatctacaatagagtgacactgacaggagaaaactttaagaaggacgggcatatcttgcggaaaaacgttgcatttcagtgtccaccatccatcttatacatcttgccagatactgtgaacaatggcatcagggtagagttcaatcaggcctatgacattgaaggtgttaccgaaaaactggttaccaaatgcagccagatgaataggcccctggcaggcagtgctgcagtacatatcccccggtatcatcacattacatatcatacaaaacttagcaaagatagggacgaaagacgggaccacatgtgcctggttgaggtggttaaagcagtcgatctagacacctatcagtgataa

SEQ ID NO: 242 - DNA, 714 bp, Escherichia coli
atgacagcactcaccgaaggagccaaactctttgagaaagagataccctatatcaccgagctggaaggagacgttgagggcatgaaattcataatcaaaggggaaggaactggagatgccaccacagggaccattaaggctaagtacatatgcaccaccggtgacctccccgtgccatgggccaccctggttagtaccctcagttatggcgtgcagtgcttcgccaagtatccctcccatatcaaagacttcttcaaatctgcaatgccagagggatatacccaagagcggacgatatcattcgaaggcgacggagtgtacaaaaccagagccatggtaacatatgaacgaggttccatatacaacagagtcacgctcactggagagaatttcaagaaagatggacacattctccgaaagaacgtagcatttcagtgtcctccgagcatactgtacatactgcctgatactgtaaacaacgggattagagttgagttcaatcaggcttatgatattgaaggagtgactgagaaactcgtcacaaagtgtagccagatgaacagaccgctcgctggatctgccgctgtgcatattccaagatatcaccatatcacctatcatacaaagctgtcaaaggatcgggatgagaggagggatcacatgtgcctcgtagaggtggtaaaggctgtggatctggatacttatcaatgataa

SEQ ID NO: 243 - DNA, 714 bp, Escherichia coli
atgacagccttaaccgagggtgccaaattgtttgagaaagagataccgtacatcaccgaactggagggcgatgtggaggggatgaagttcatcattaagggggagggaacaggcgatgccactactgggaccattaaggccaaatacatttgtacaaccggcgacctgcctgtcccttgggccactctggtttccactctatcatacggagtacagtgttttgccaaatacccctcccatatcaaagactttttcaaaagtgccatgcccgaagggtatacacaagagagaactattagcttcgaaggcgacggcgtgtataagaccagggccatggtcacatatgaacgtggtagcatatacaatcgagtcactcttactggagagaatttcaagaaagacgggcatatacttagaaagaatgtggcctttcagtgtccaccgtcaatcttatacatcttgcccgataccgttaacaatggcattcgagttgagtttaaccaggcctacgacattgagggggttacagagaaactggttaccaaatgtagccagatgaatcgcccactggctggatctgccgctgtacatatcccgcggtaccaccacataacatatcacaccaaactatctaaagacagggacgaacggcgcgaccatatgtgcctagttgaagtggttaaagctgttgacttagacacttaccaatgataa

SEQ ID NO: 244 - DNA, 727 bp, Escherichia coli
aaggaggtaaaaaatgacagctttgactgaaggcgctaaactgttcgaaaaagagatcccatacatcacggaattagaaggggatgtcgagggcatgaaattcattatcaaaggagagggaaccggcgacgccactaccggcacaatcaaagcaaagtacatatgcactacgggcgatctcccagtcccttgggccaccctggtgagcacactatcctatggtgtgcaatgtttcgccaaatacccctcccacattaaggactttttcaaatccgctatgcctgaaggttatacccaagagcgcactatttccttcgagggagatggcgtgtacaagacacgggctatggttacctatgagaggggcagcatatacaatcgcgtcacgctgaccggggagaatttcaagaaagatggccatatacttcgcaaaaacgtggccttccagtgccctccgagcatactgtacatactgccagatacagtgaacaatgggattagggtcgagtttaaccaagcctatgatatagagggtgttacagaaaagttagtgacgaaatgcagccagatgaatcggccacttgctgggagcgccgcagtccacataccccgctatcatcacattacatatcacaccaaactgtccaaagatcgcgacgagcgccgcgaccacatgtgcttggtggaggttgtcaaggcagtggatctcgatacctatcagtgataa

SEQ ID NO: 245 - DNA, 714 bp, Escherichia coli
atgaccgctttgaccgagggggcaaaactgttcgagaaggaaattccctatatcaccgaactggaaggagacgtagaagggatgaaattcatcatcaaaggcgagggcactggggacgcaaccaccggtactatcaaggccaagtacatctgtacaaccggcgatcttccggtcccctgggcaacattagtaagtaccctatcttacggagtgcagtgttttgccaaatacccatctcacatcaaggacttctttaagtccgctatgccagaaggttacacccaagaacgaaccatctccttcgagggcgacggagtgtacaaaactcgtgcgatggtgacctacgagcggggcagcatctacaatagggtgaccctaaccggagaaaacttcaagaaagatggccacatcttacgcaagaacgtggccttccagtgtccgcccagtatcttatacatcttgccggataccgtcaataacggcattagagtggaattcaaccaggcttatgacattgagggggttactgaaaaactggtgaccaagtgcagccagatgaaccggcctctagcaggctcagctgcagtgcacatccctcgctatcaccatatcacctatcacaccaaactgtctaaagatagggacgaaagacgtgatcatatgtgtctggtagaagtcgttaaagccgttgatcttgatacctaccaatgataa

SEQ ID NO: 246 - DNA, 714 bp, Escherichia coli
atgactgctctgaccgagggcgccaaactcttcgagaaagagattccgtacatcacagagctcgaaggagacgtcgaagggatgaaattcatcatcaaaggagagggcactggtgacgctaccaccggtaccatcaaagctaagtacatctgtaccactggggacctgcctgtcccctgggctaccctcgttagcactctgtcctacggtgtccaatgttttgctaagtacccctcccacatcaaagatttcttcaaatccgccatgccagagggctacacacaagagaggactatcagctttgagggagacggcgtgtacaaaacaagagctatggtcacttacgagcgcggtagcatctacaatagagtgaccctgactggcgagaatttcaagaaagacggtcacatcctccgaaagaatgtggctttccagtgtccgccgagcatcctctacatcctgccagatacagtgaacaatggtatccgggtggagtttaaccaggcctatgacatcgagggtgtgactgagaaactcgtgacaaagtgcagccagatgaaccggcccctggcagggtccgctgccgttcatattcctcgataccatcacattacctatcacacaaagctctccaaagacagagacgaacgcagggaccacatgtgcctcgtcgaggtcgtgaaagcagttgacctcgatacatatcaatgataa

SEQ ID NO: 247 - DNA, 714 bp, Escherichia coli
atgaccgccctcactgagggagccaaactgtttgaaaaagagataccctacattaccgaactcgagggcgacgtcgaggggatgaaattcattatcaagggcgaaggcactggggatgccactaccggcaccatcaaagccaaatacatctgcacaaccggggacctcccagtcccgtgggctaccctcgtctccacactgtcctatggggtccagtgctttgcgaaatacccatcgcacatcaaagactttttcaagtcagctatgcccgaaggatacacccaagaacgcaccatttcttttgaaggagatggcgtgtataagaccagagccatggttacctatgagcgtgggtcaatctacaatcgggtgaccctcaccggggaaaactttaagaaagatgggcacattctgcggaaaaacgtcgcgtttcagtgcccaccttcgatcctctacatcctcccggataccgtcaacaatgggattagggtcgaattcaatcaggcatatgacatagaaggggtcaccgaaaagctggtgacaaagtgtagccagatgaatcgtcctctcgccgggagcgcagctgtccacatcccccgatatcatcatatcacctatcataccaaactcagcaaagaccgcgacgaacgtagagatcatatgtgcctggtggaagtggttaaagcagtggatctggatacctatcaatgataa

SEQ ID NO: 248 - DNA, 714 bp, Escherichia coli
atgaccgctctcacggaaggtgcgaaactttttgaaaaagaaatcccctacattacagaactcgagggtgacgtcgagggtatgaaattcataatcaaaggcgagggcactggcgatgccaccactgggacgatcaaggccaaatacatttgtacgaccggagatcttccagttccatgggctacactggtttcaaccctgtcttatggtgtccagtgcttcgcaaagtacccatcccacataaaggactttttcaagtccgccatgcccgaggggtatacgcaagaacggacaatctcatttgaaggtgatggagtttacaaaacgcgggctatggtaacatatgaaaggggtagcatatacaatcgggtgacactgacgggtgagaatttcaagaaagatggccacatcctgaggaaaaacgtcgcgtttcagtgtccacctagcatattgtacattctcccagacaccgtgaataacggcattagagtcgagtttaaccaggcctacgatattgaaggagtaactgagaaactcgtaaccaaatgcagtcagatgaatcggccactggcaggaagcgcagccgtgcacattcctcgctaccaccatatcacgtaccacacaaaactctccaaagacagggatgagcgcagagatcatatgtgtttggtggaagttgtgaaagccgtggacctggacacctaccagtgataa

SEQ ID NO: 249 - DNA, 714 bp, Escherichia coli
atgacagcactgaccgagggcgcaaagctatttgagaaggagattccttacatcactgaattggagggagacgtggagggcatgaaattcatcatcaagggggagggaacgggtgatgccacgaccggtaccataaaggccaaatacatctgtaccactggagatctgccagtgccatgggctacattagtgtcaacactctcatatggggtccagtgttttgctaagtacccatctcatatcaaagactttttcaaaagtgccatgccagagggctacacacaagagcggacgatttcatttgaaggagatggagtctataagacccgcgccatggtgacctatgagcggggatccatctacaatagggtgaccctgacgggagaaaactttaagaaagatgggcacattcttcgcaagaacgtggcctttcaatgccctccctcaatactttacatcctacccgatacagtgaataacgggattagagtggagttcaaccaggcctacgacatcgagggcgtgacagagaaactcgtgacaaagtgcagccagatgaataggccactggctggttctgctgccgtgcatatcccacggtaccatcacattacctaccatactaaactgagtaaagatcgggacgagagaagggatcacatgtgtttggtggaggtcgtgaaagccgtggatctggatacttaccagtgataa

SEQ ID NO: 250 - DNA, 714 bp, Escherichia coli
atgacagctctgacagaaggagcaaaactgtttgaaaaagagataccatacataacagaactcgaaggggacgtggaagggatgaaattcattatcaaaggcgaagggacaggggacgcaacaaccggaaccataaaggcaaagtacatatgcacaacaggggatcttcccgtgccatgggcaacactcgtgtctacactctcttacggggtgcagtgttttgccaagtacccttctcacattaaggacttcttcaaaagcgctatgccagaaggctatacccaagagagaacaatatcttttgagggggacggcgtgtacaaaactcgcgccatggtgacttatgaaaggggctccatatacaaccgcgtgactctgacaggcgagaacttcaagaaggatgggcacattttgcgcaagaatgtggcattccagtgtccaccaagcattttgtacattctgcccgatacagtcaacaacggaatacgcgtggaattcaatcaggcctacgacatcgagggggtgacagagaagcttgtgaccaaatgtagtcagatgaatagaccactggctgggagtgcagcagtccatatccctcggtaccatcacatcacatatcatactaaactcagtaaagacagggatgagcggcgggatcatatgtgtctcgtggaggtcgtgaaagcagtggacctggacacatatcaatgataa

SEQ ID NO: 251 - DNA, 714 bp, Escherichia coli
atgacagcattaactgaaggcgcgaaactattcgagaaagaaattccctatatcactgaactggagggcgacgtcgaagggatgaagttcatcataaagggagagggtacaggcgacgctacaactgggaccattaaggcgaagtatatctgcactactggagacttgccagtgccatgggccactttagtgtcaactctgagttacggtgtgcaatgttttgccaagtatccatcacacatcaaagactttttcaaatctgcgatgccggaaggctatacccaagaaagaacaatttcatttgagggagacggtgtgtacaaaaccagagctatggtgacatatgaacgagggtccatctacaatagagtaactttaactggagagaactttaagaaagatggtcacattcttcgaaagaacgttgcatttcaatgtcctcctagtatactgtacatacttcccgacactgtcaataacggcattagagtggaattcaaccaggcctatgacatagagggggttaccgagaaactggtgaccaaatgcagccagatgaatcgacccctagccggctcagccgcagtgcatattccgaggtatcaccacatcacctatcatactaagttgtctaaagatagagatgagcggcgggatcacatgtgcctggtggaagtcgtgaaagcggtagacctagatacttatcagtgataa

SEQ ID NO: 252 - DNA, 714 bp, Escherichia coli
atgaccgccctgaccgagggagccaagttgttcgagaaagaaataccttacattaccgagttggagggggacgtcgaagggatgaagttcataatcaagggcgagggtacaggggacgccaccacaggcaccatcaaggctaagtacatctgcaccacaggggacctgcccgtcccctgggctactctcgtctccactctgagttacggggttcagtgtttcgccaagtacccttctcacatcaaggactttttcaaaagcgcaatgcccgaaggctacacccaagaaagaaccatctcttttgagggagatggtgtgtataagactagggctatggtcacctacgagaggggcagcatctataacagagtgacgctgactggcgagaatttcaaaaaggacggacatatactgcggaagaacgtcgcgttccagtgtccaccaagcatcctgtacatcctcccggatacggttaacaatggcattcgggttgagtttaaccaggcatatgacattgaaggagtgaccgagaaactcgtgacaaagtgcagccagatgaatcggcctctggccgggtccgcagccgtgcacattccccggtaccaccacattacgtaccataccaaattgtccaaagacagggatgagcgccgcgatcacatgtgcctggtggaagtggtcaaggcggtggatctggacacttatcaatgataa

SEQ ID NO: 253 - DNA, 714 bp, Escherichia coli
atgaccgcccttactgagggtgcaaagctctttgagaaggaaatcccgtacattaccgaattggaaggcgacgtggagggcatgaagttcattatcaagggtgagggaaccggcgacgctactaccggcaccatcaaggccaagtacatatgcactacaggggacctccccgtgccctgggctaccttggtgtccaccctttcttacggtgtgcagtgctttgctaagtacccctctcacataaaggactttttcaagagcgccatgcctgaaggttacacccaagagcggaccatcagttttgaaggtgatggagtgtacaagaccagagccatggtcacctatgaacgcggctcaatctacaatcgcgtcaccctgaccggtgagaatttcaagaaagatggtcatatcctgcgcaagaacgtggcatttcagtgccctcccagtattctctacatactgccagataccgtgaataacgggattagagtggaattcaaccaggcctatgacatcgagggagtgaccgaaaaacttgtgaccaagtgtagccagatgaatcgccccctggcaggatcagccgctgtgcatatcccaaggtaccaccatatcacttaccacaccaagctgtccaaagacagggacgagcggcgggaccatatgtgccttgtcgaagtggtgaaagctgtggacctggacacatatcaatgataa

SEQ ID NO: 254 - DNA, 714 bp, Escherichia coli
atgacagctctgactgagggtgcaaaactgtttgagaaggagattccctacattaccgaactggagggtgatgtggagggtatgaagtttatcattaagggcgaggggacgggcgacgccacaacaggcacaatcaaggcaaagtacatctgcactacaggggacctgcctgttccttgggcaacactggtttcaaccttgtcatatggggtccagtgctttgccaagtatccctctcacattaaggacttctttaagagcgcaatgcctgaaggttacacacaagaaagaacgatttcctttgagggagatggagtctacaaaacacgtgctatggtgacctatgagcggggaagcatctacaatagggtcaccctgaccggcgagaactttaagaaagatggacacattctgcgtaagaacgtcgctttccagtgtcctccaagtattctgtacattttgccagatactgtcaacaatggcattagagtcgagttcaaccaggcatacgacattgagggcgtgacggagaagttggtcactaaatgcagccagatgaatcgccccctggcaggatccgcagcagtccatatcccaaggtaccatcacattacttaccataccaaactgtctaaggaccgcgatgagcggcgagatcatatgtgcttggtggaggtggtgaaagccgtcgatctggacacataccaatgataa

SEQ ID NO: 255 - DNA, 714 bp, Escherichia coli
atgacagcacttaccgaaggcgcaaaactttttgagaaggagataccatacattacagagctcgagggtgatgtggagggcatgaagttcatcatcaagggcgaggggacaggcgacgccaccaccggcacgatcaaggcgaagtacatttgcacgacaggcgatctgcccgtgccttgggccactctggtcagcacactttcttatggcgtccagtgctttgccaaatacccttctcatatcaaagactttttcaagtccgccatgcctgagggttatacacaagagcggaccatcagtttcgagggcgacggggtgtataagacccgagctatggtgacctatgagagaggcagcatatacaatagagtgacgctcaccggcgagaatttcaagaaggacggccacattctccgaaagaacgtggcattccagtgtcctccatctattctttacattctccctgacactgtgaacaatggcatcagagtggagttcaatcaggcctatgacattgaaggcgtgaccgagaagcttgtgactaaatgtagtcagatgaacagacctcttgctgggtcagctgcggtgcacattccccggtatcaccatatcacgtatcataccaagctgtccaaggatagagacgaacgaagggatcatatgtgtcttgtggaggtggtgaaggccgtcgacctggatacttaccagtgataa

SEQ ID NO: 256 - DNA, 714 bp, Escherichia coli
atgactgcacttactgaaggggcaaagctctttgagaaagagattccttacattactgagctcgaaggggacgtcgaggggatgaagttcatcattaagggagaggggactggggacgccacaactggcaccatcaaagctaagtacatctgcacaacaggggacctccctgtgccctgggccacactggtcagtacactctcatacggcgtgcagtgttttgcaaagtatcccagccacattaaggatttctttaagtccgcaatgcccgagggctatacccaagaacggaccatttcatttgagggcgatggggtatacaagactcgggcaatggtaacctacgagagaggctcaatctacaatcgggtgacacttactggggagaactttaagaaagacgggcacattttgcgcaagaatgtggcatttcagtgccctccgtctatcctgtacattcttcccgatacagtgaataacgggattagggtggagttcaatcaggcctacgatattgagggagtgaccgagaaactggttaccaagtgtagtcagatgaatcgcccactggcaggatcagcagctgtccacattccaaggtatcatcacattacctatcataccaagctgtctaaggatagagacgagcggagggaccacatgtgcctggttgaggttgtgaaggctgtagatttggatacttatcaatgataa

SEQ ID NO: 257 - DNA, 714 bp, Escherichia coli
atgaccgccctgacagagggggctaagctttttgagaaagagattccctatatcactgagctcgaaggggatgttgagggcatgaagtttatcatcaagggcgaagggaccggagacgctacaacaggaacaatcaaagctaagtatatctgcacaactggagatctgcctgtgccttgggctactctcgtctctacacttagctatggcgttcagtgttttgctaagtacccttcccacataaaggatttctttaagtcagctatgcctgaggggtacacacaagaaagaacaataagctttgaaggggacggggtgtataagacaagggccatggtgacatacgagagagggtccatatacaacagagtcacactgacaggggaaaactttaagaaggatgggcacatcctgaggaagaacgtggcattccagtgtccaccctctattctttacatccttcctgatacagtcaataacgggatccgggtggaattcaatcaggcttatgatattgagggcgtgaccgaaaagcttgttacaaaatgtagccagatgaatagacctcttgctggcagtgccgcagtgcacattccaagatatcatcacatcacttatcataccaaactctcaaaagatcgggatgaacgacgagatcacatgtgccttgtcgaagtcgtgaaagccgtcgacctcgacacataccagtgataa

SEQ ID NO: 258 - DNA, 714 bp, Escherichia coli
atgaccgcactgaccgagggtgccaagctgtttgagaaggagattccttacatcacagaattggagggcgacgtggaggggatgaaattcattatcaagggtgaagggacgggagatgcaaccacgggaaccattaaggcgaaatacatctgtacaaccggcgatctgcctgttccttgggccacactggtgtcaacgctgtcttatggagttcagtgttttgccaagtatccctcacacattaaggacttctttaagtcagcaatgcctgagggctatacccaagaaagaacgataagctttgaaggggacggagtgtataagactcgtgcaatggtgacatatgagcgagggtctatctacaatagagtgaccctgaccggagagaacttcaaaaaggacggtcatatactgcgtaagaatgtcgcctttcagtgccctccaagtatcttgtacatcctgcccgacacagtgaacaatggcatccgggtagaattcaatcaggcatatgacatagagggagtaactgagaagctggtcactaaatgtagtcagatgaatcgccctctggctggctcagctgctgtccacatcccaaggtatcaccacatcacatatcacactaagttgtccaaggatcgggatgagcgccgtgaccatatgtgtttggttgaggtagtgaaggctgtggacctggatacctatcaatgataa

SEQ ID NO: 259 - DNA, 714 bp, Escherichia coli
atgacagccttgaccgagggtgccaagttgttcgaaaaggagattccatacataacagaactggagggagacgtagaagggatgaagttcattatcaaaggcgagggaacaggggacgccacaaccggtaccataaaggccaagtatatctgcacaacaggcgacctgcctgtgccatgggccacattggtatccacactgagttacggcgtgcaatgttttgccaagtaccccagccatatcaaggatttctttaagtctgccatgcctgaaggctatacacaagagagaaccatctctttcgaaggcgatggggtgtacaagacacgcgccatggtaacttacgagagaggttctatctacaatcgggttacactgactggcgagaatttcaagaaggatggacatatactgagaaagaatgtggccttccaatgtcctcctagtatcctgtatatcctgcccgatactgtcaacaacgggattcgggtggaattcaatcaggcttacgatattgagggcgttactgaaaagttggttacaaaatgcagccagatgaatcgaccactggccggcagtgccgctgtgcacattccccgataccaccatatcacatatcatacaaaactgtctaaggatcgcgatgaaaggagggatcacatgtgcctggtagaagtagtcaaagccgtggatctggacacataccagtgataa

SEQ ID NO: 260 - DNA, 714 bp, Escherichia coli
atgacagccctcactgaaggagccaagttgtttgagaaggaaattccctatatcactgagctcgaaggagatgtggaagggatgaagttcattatcaaaggcgaaggaaccggtgacgctactactggaactatcaaggccaagtacatttgtactactggcgacttgcccgtgccttgggccactttggtgtcaacactgtcatatggtgtccagtgtttcgccaagtatcctagtcacattaaggacttcttcaagtctgccatgcccgaggggtatacacaagaaaggactatttcttttgaaggggatggtgtttacaagactcgcgccatggtaacctatgaacgcgggagcatatacaatcgggtgaccctgacaggcgagaatttcaagaaagatggacacatcctgcgcaagaatgtcgccttccagtgtcccccaagcattctgtatatcctgcccgataccgttaacaacggaatacgcgtggaattcaatcaggcctacgatattgaaggcgtgactgagaagctggtcaccaaatgtagtcagatgaaccgccccctggccggatccgccgctgtacacataccccggtatcaccacatcacctatcatactaagctgtccaaggatagggatgaacgccgcgaccatatgtgcctcgtggaagtggtgaaagccgtggatctggatacatatcagtgataa

SEQ ID NO: 261 - DNA, 714 bp, Escherichia coli
atgactgcgctgaccgagggtgcgaaattgttcgagaaggagattccctacattactgagctggagggagacgttgagggtatgaaattcattatcaagggcgaagggactggagatgcaacaactggaactatcaaggccaaatacatctgcacaaccggggatctgcccgtgccctgggccacacttgtcagcaccctctcctatggcgtgcaatgttttgctaagtaccccagccacattaaggatttcttcaaaagcgccatgcccgagggttatacccaagaacgcacaatctcctttgagggtgacggtgtctataagactagggcaatggttacatatgaaaggggtagcatctataaccgcgttaccttgaccggcgagaatttcaaaaaggacggtcatatactccgcaagaacgttgcgttccaatgtccaccctccatactttacattcttcctgataccgtaaacaacggaatacgcgttgagttcaatcaggcttatgatatcgaaggcgtaaccgagaagctggttactaagtgtagccagatgaaccgccccctcgcgggctccgcagccgtgcatatccctcgctatcaccatatcacctatcatactaagctgtccaaagaccgcgacgaacggcgggatcacatgtgtctggtcgaagttgttaaggccgtggacctcgatacatatcagtgataa

SEQ ID NO: 262 - DNA, 714 bp, Escherichia coli
atgaccgctctgaccgaaggcgccaagctgtttgaaaaagaaattccttacattaccgaactcgaaggggacgttgaagggatgaagttcatcattaagggcgaggggaccggcgacgctactaccggtaccatcaaggctaagtatatctgtaccaccggtgatttgcccgtgccctgggccaccctggtgtccaccctgtcatatggagttcagtgctttgccaagtacccctcgcacatcaaagatttctttaagagcgctatgcccgaaggatatacccaagagaggacaattagctttgaaggcgacggtgtctacaaaacaagagcaatggtcacctacgaaaggggctcgatctataaccgggtcaccctgactggcgaaaacttcaagaaagacggccacattctgaggaagaacgtggcatttcaatgcccaccttcaattctgtacattctccccgacactgtaaacaacgggattcgcgttgagttcaatcaggcatatgacattgagggagttactgaaaagttggtgaccaagtgtagccagatgaatcggcccctggccggctccgccgctgttcatattccccggtatcatcacattacctatcataccaaactctctaaagaccgcgacgagaggcgggaccatatgtgtttggttgaagttgttaaggctgtagatctggacacctaccaatgataa

SEQ ID NO: 263 - DNA, 714 bp, Escherichia coli
atgacggccctcacggaaggggctaaactttttgaaaaggaaattccttacataactgagctcgagggtgacgttgaagggatgaaattcattatcaaaggagaaggaacgggcgacgccaccactggaaccattaaggccaagtatatctgcacaaccggggaccttccagtcccctgggcaacactcgtaagcaccctctcctacggagtacagtgcttcgctaagtaccccagccacattaaggacttctttaagtccgccatgcctgaaggctatacacaagagcggaccattagcttcgaaggagacggagtctacaagactcgggccatggtgacctacgaacgcggaagcatctacaaccgagtcacacttactggagagaacttcaaaaaggacggacacatactgaggaaaaacgtcgcatttcaatgccctccctccatcctttacattctgcctgacacggttaacaacggaatcagagtggaattcaatcaggcttatgatattgaaggtgttacggaaaaacttgttacgaagtgtagccagatgaataggccactggccgggtccgctgccgtgcatatcccaagataccaccacatcacataccataccaagctttccaaggaccgtgatgagcgccgtgatcacatgtgcctggtggaagttgtgaaggccgtggaccttgacacgtaccagtgataa

SEQ ID NO: 264 - DNA, 714 bp, Escherichia coli
atgacagctctgacagaaggagcaaaactctttgaaaaagaaatcccttacatcactgagctcgaaggtgatgtagaagggatgaagttcattatcaaaggagagggtactggcgacgccactaccgggactatcaaagccaaatacatctgcaccacaggcgacctccccgttccttgggccaccctcgtctctactctcagttatggtgttcagtgttttgccaagtatcccagccacatcaaagacttctttaagtccgccatgccagaaggctatacacaagagcgcactatcagctttgagggcgatggcgtgtataagacccgcgctatggttacatatgagaggggatctatctacaatagagtgactctgactggcgagaatttcaagaaagacggccacatcctccggaaaaacgttgcatttcagtgccctccaagtattctgtacatcctccctgatactgtgaacaatggcatccgcgtcgagtttaaccaggcctatgacatcgagggggttactgagaaactcgtgactaaatgcagtcagatgaacaggcctctggcagggtctgctgccgttcacatccctcggtatcatcacattacttatcacaccaagctgtctaaagaccgcgatgagagacgggaccacatgtgtctcgttgaggtcgtaaaagccgttgatctggacacctatcagtgataa

SEQ ID NO: 265 - DNA, 714 bp, Escherichia coli
atgacagcacttactgaaggagctaagcttttcgagaaggaaataccttacattacagagctggaaggtgacgtcgaagggatgaaattcatcatcaaaggagagggcactggagacgccacaactggcacaatcaaggcgaaatacatttgcaccaccggggatctacctgtaccttgggccactttagtttccactctgtcatatggagtgcagtgcttcgccaagtatccctcacatatcaaggacttcttcaaatcggcgatgccagagggatatacacaagaacggacaatttcctttgaaggagacggagtgtacaaaacccgggcaatggtgacctatgagaggggatctatctataaccgcgtcactctgactggcgagaatttcaagaaggatgggcacattttgcggaaaaacgtggcttttcagtgtcctccaagcatcctgtacattctgcccgacacagtgaataacggaatacgcgttgagttcaatcaggcatacgacatcgaaggagtcaccgagaaattggtgactaaatgcagccagatgaataggcctttagctggttcggcagcagtgcatatccctagatatcaccatatcacctatcataccaagttaagcaaagacagggacgaaagacgggaccatatgtgcctagttgaagtagtaaaagccgtggacctagatacctaccagtgataa

SEQ ID NO: 266 - DNA, 714 bp, Escherichia coli
atgaccgctcttaccgagggagctaagctgtttgagaaagagataccctacattactgaacttgagggagatgtagagggtatgaagtttatcatcaaaggggagggcaccggtgacgctacaacgggaactatcaaagctaagtatatctgcacgactggcgacttgcctgtgccctgggccacgctcgtgtccaccctcagctatggagtccagtgcttcgccaagtaccccagccacattaaggacttcttcaaatcagctatgcccgaggggtatacacaagaacgcacaatatcattcgaaggggatggcgtttacaaaaccagggctatggttacgtacgagcgagggtctatctacaaccgggtgacattgacgggagagaatttcaaaaaggatggccatattctgaggaaaaacgtcgcatttcagtgcccaccttcaattctgtacattctgcccgacaccgtaaacaatggtatccgggtggagttcaatcaggcatatgacatagagggagttacggagaaactcgtgacaaaatgcagtcagatgaacagacccctcgccggatctgctgccgtccatattccaagatatcatcacataacatatcatacgaaactgtcaaaagatcgagatgagcgcagagatcatatgtgtctggttgaggtcgtgaaagctgttgatctcgacacctatcaatgataa

SEQ ID NO: 267 - DNA, 714 bp, Escherichia coli
atgacagccttgacagagggggccaaactgtttgaaaaagagatcccgtacataaccgaactggagggcgacgttgaggggatgaagtttatcattaagggggaggggactggggacgccacaacaggaaccattaaggccaaatacatctgcactacaggcgatctcccagtcccttgggctacactggtcagcacactttcctatggagtgcagtgttttgccaagtatccctcccacataaaggacttcttcaaaagcgccatgcctgagggatatacacaagagcgcacaatctcctttgagggagacggcgtatacaaaacacgggcaatggtgacatacgagcggggcagcatatacaatagagtgaccctaacaggggagaactttaagaaagatgggcatattcttcgcaaaaacgtggcttttcagtgtccaccctccatactgtacattctacctgatacagtgaataacgggataagggtggagttcaatcaggcttacgatatagagggggttactgagaagttagtgacaaagtgtagccagatgaatcgtcccctggcagggagcgcagccgtacatattccccgttaccatcacataacttaccataccaaactctccaaagaccgagacgaaagaagggaccatatgtgcctggtggaggtagtcaaagccgttgatttggacacataccaatgataa

SEQ ID NO: 268 - DNA, 714 bp, Escherichia coli
atgaccgcattaaccgagggcgccaaactattcgagaaggagatcccctatatcactgagttggagggtgacgtggagggcatgaagttcataatcaaaggggagggcaccggtgacgccaccacaggcaccataaaggctaagtatatctgtaccactggcgacctgccagtgccttgggctacattagtgtccactctgtcctacggcgtgcagtgctttgctaagtatcctagtcatatcaaagatttctttaagagcgctatgcccgagggctatacccaagagaggaccatttcttttgagggggatggcgtgtataagaccagggcaatggtgacctatgaaagaggctccatatacaatcgcgtgaccctgaccggggagaatttcaaaaaggacggccacattcttcggaaaaacgtcgctttccaatgcccaccttcaattctgtacattctgcctgataccgtgaataacggcatccgggtggaattcaatcaggcatatgacattgagggcgtgacagagaaactagtgaccaaatgcagccagatgaatcggcctttagctggcagcgccgctgtccacatacctcgctatcaccacattacctaccacaccaaactttcaaaagatagggacgaacgcagagatcacatgtgtttggtggaggtcgtgaaggccgtggatctagatacctatcagtgataa

SEQ ID NO: 269 - DNA, 714 bp, Escherichia coli
atgacagcactgacagagggggcaaaactgtttgaaaaagaaattccctacattaccgagctggagggggatgttgagggcatgaaattcatcataaagggcgaaggcaccggcgatgcaaccaccggcacaatcaaagctaagtatatctgcacgactggcgatctgccagttccttgggcaactctcgtatcaaccttgtcatacggggtgcagtgtttcgccaagtaccctagtcacatcaaagatttcttcaaatctgcaatgcccgaaggctacacccaagaacgtacaatctcatttgaaggtgacggcgtttacaaaacacgcgctatggtcacgtacgaaaggggctccatctataaccgggttacactgacgggcgagaacttcaaaaaggacggccacattctgcgcaagaatgtagcattccagtgcccgccatctatcctatacattctccccgatacagtgaataacggcatacgtgtggagtttaaccaggcctacgatatcgaaggtgttactgaaaagcttgttacgaaatgtagccagatgaaccgacctttagcaggctcagcagctgttcacatcccccggtaccaccacattacctaccacaccaaattgagtaaagaccgtgatgagagaagagatcatatgtgtctagtggaggtcgtcaaagccgttgatcttgacacttatcagtgataa

SEQ ID NO: 270 - DNA, 714 bp, Escherichia coli
atgacagccctgacagaaggcgcaaaactctttgaaaaagagataccttacatcacagaattggagggcgatgtcgagggcatgaaattcatcattaagggtgaaggaacaggtgacgctaccacagggaccatcaaagccaaatacatctgcacaacaggggacctgcctgtcccctgggctacactcgtgagcacactgtcatacggagtgcagtgttttgccaagtacccatcccacatcaaagacttcttcaagtctgcaatgcctgaaggatatactcaagagagaacaatcagtttcgagggagatggagtgtacaaaactcgggctatggtgacatacgagagaggttccatatacaatcgggtgacactgactggggagaatttcaagaaagacggccacattctgagaaagaacgtggctttccagtgtcccccatctatcctttacatcctccccgacacagtgaataacggcatcagggtggagttcaatcaagcctatgatattgagggtgtcaccgaaaaactggtgaccaagtgtagccagatgaataggcccttggcaggctcagccgctgtgcacattccgagatatcatcacattacttaccacacaaagctcagcaaagaccgagacgagagacgagatcacatgtgtctcgtggaggtggtgaaggccgtggaccttgatacatatcagtgataa

SEQ ID NO: 271 - DNA, 714 bp, Escherichia coli
atgacggccctgaccgaaggagcaaaactctttgaaaaagaaatcccctatatcactgagctcgaaggcgacgtagaggggatgaaattcatcatcaagggtgagggcactggggatgccaccacgggaaccattaaggcgaaatacatctgcacaaccggggatcttcccgtcccctgggcgactctggtgtccaccctcagttatggggttcaatgctttgccaagtatccctcccatatcaaagatttctttaagagcgcgatgcccgaagggtatacacaagagcgtactattagttttgagggagatggcgtatacaaaacgagggcaatggtgacatacgaacgcggctctatctacaatcgtgtgaccctgacaggcgaaaacttcaagaaggatgggcatatcctgaggaagaatgtcgcatttcaatgtcctccttctatcctgtatatcttgcccgacacagtgaacaatggtatccgagtcgagttcaatcaggcctatgatattgagggagtgacggagaaactcgtgaccaagtgcagccagatgaatagaccccttgcgggctccgctgccgtgcatatcccacggtatcatcacatcacatatcataccaagttgagcaaagaccgggatgaaagacgcgaccacatgtgtctggtggaagtggttaaagctgtggatctcgatacatatcagtgataa

SEQ ID NO: 272 - DNA, 714 bp, Escherichia coli
atgactgctctcaccgaaggcgcgaagctgttcgaaaaagaaatcccctacatcaccgagctcgagggagacgtagaagggatgaaattcatcatcaagggagaagggaccggcgacgcgacgacaggtaccattaaggccaaatacatatgcacgaccggggacctccctgtcccttgggccacactcgtatccaccctgagctacggtgttcagtgttttgcgaagtacccctcccacattaaggactttttcaaaagcgccatgcctgaaggctatacacaagaacggaccataagctttgagggagatggcgtctacaagaccagagcgatggttacttatgaaaggggctccatatacaatagggttaccctcacgggtgagaatttcaaaaaggatggccacatactgcggaaaaacgtggcctttcagtgtccaccaagcattctctacattctgccagataccgtgaataacggaatacgcgtggagtttaaccaggcatatgatatagaaggtgtgacagaaaaactcgtgaccaaatgtagccagatgaataggcctctggcaggatccgcagctgtgcatattccccgctatcaccacataacttaccacactaaactctccaaagatcgggatgaacggagggatcacatgtgtctggtagaagtggtaaaggccgtagatctcgatacttaccagtgataa

SEQ ID NO: 273 - DNA, 714 bp, Escherichia coli
atgacagccttaaccgagggtgctaaactttttgagaaagagatcccatacattaccgaattggaaggggacgtggaggggatgaaattcatcatcaagggagagggaaccggagatgctaccaccgggaccatcaaagccaagtacatttgtaccactggagatctacccgtcccctgggccaccttggtgtctaccctgtcctacggagtgcaatgttttgctaagtacccaagtcacatcaaagacttcttcaaatccgccatgcctgaaggatacactcaagagagaaccatctcttttgagggcgatggagtgtacaaaacccgggccatggttacctatgagaggggaagcatctacaaccgcgtcacccttaccggcgagaatttcaaaaaggatggacatatcctgaggaagaacgttgcctttcaatgcccaccttctatcctatacatcctacctgacaccgtcaacaatggcatcagggtcgagtttaaccaggcctatgatattgagggtgtgaccgagaaactggtcaccaagtgtagtcagatgaaccggcccttagccggatcagccgccgtccatatccctagataccaccatatcacttatcatacaaaactgagcaaagaccgggatgaaaggcgggaccatatgtgtctggtggaagttgtgaaagccgtggacttagatacttatcagtgataa

SEQ ID NO: 274 - DNA, 714 bp, Escherichia coli
atgaccgcgctgaccgaaggggccaagctcttcgagaaagagataccctacataacagaactcgaaggagacgtcgaagggatgaaattcattatcaaaggggaaggaacaggcgacgctactactggcaccatcaaggccaaatacatttgcaccactggcgacctgccagtgccttgggcgacactcgtgtcaactctcagctacggggttcagtgcttcgctaagtatcctagtcatatcaaagacttcttcaagtctgcaatgccagaaggatacacccaagaacgcaccatcagttttgaaggtgacggcgtgtataagacccgcgcaatggtcacttacgagcgcgggtccatctacaaccgcgtcactctcaccggagagaacttcaaaaaggatggccatattctccgcaaaaacgtggcctttcagtgtcctccttccattctctacattctgcccgatacagtgaacaatgggataagggtcgaattcaatcaagcttacgacattgaaggcgtgacagagaaactggttacaaaatgtagccagatgaacaggcccctggcaggttctgcagcagtgcacataccacggtatcatcatatcacttaccacactaaactgtcaaaagaccgcgatgaacgccgggaccatatgtgtctcgtggaagtcgttaaagccgtcgacctcgacacataccaatgataa

SEQ ID NO: 275 - DNA, 714 bp, Escherichia coli
atgactgcgctaaccgagggcgcgaagctattcgaaaaagaaattccttacataaccgagttggagggtgatgtggaagggatgaaattcataatcaaaggagaaggtactggcgacgccacaacaggaaccataaaggccaaatacatttgtacgacgggggacctgcccgtgccctgggctacgcttgtgtctacactctcctatggtgtccagtgctttgccaagtaccccagccacataaaggacttctttaagtcagcaatgcctgaaggctatacacaagaacggacaatttcctttgaaggtgatggtgtctacaaaactagagcaatggtcacttatgaaaggggtagcatatacaatagagtcacattaaccggggaaaactttaagaaagacggccatatcctgcgcaaaaacgtggcctttcaatgcccacccagtatcttatacatactgcccgacactgtgaacaacggaattagggttgagtttaaccaggcatatgacatcgaaggtgtcacagagaaactcgtcaccaaatgcagtcagatgaatcgaccccttgctggctctgccgccgtccacattccccggtatcaccacataacctatcacacaaaactgtcaaaagacagagacgaacgacgcgatcacatgtgcctggtcgaggtcgtgaaagctgttgacttggacacatatcagtgataa

SEQ ID NO: 276 - DNA, 714 bp, Escherichia coli
atgaccgccctgaccgaaggagccaagctgttcgagaaggaaattccgtacattaccgaacttgaaggagacgtggagggtatgaagttcatcattaagggagaaggaactggagacgctactaccggaactatcaaggccaagtacatttgcaccaccggtgaccttcccgtcccgtgggctactctcgtgtcaaccctttcatacggagtgcagtgcttcgccaagtacccttcgcatatcaaggacttcttcaagtcagccatgcccgaaggatacacccaagagcgcactatcagcttcgaaggtgacggagtgtacaagacccgcgcgatggtgacttacgaacggggatctatctacaaccgcgtgactctgaccggagaaaacttcaagaaggacggacacatcctccgcaagaacgtcgctttccagtgccctccctcaatcctgtacatcctgcctgacaccgtcaacaatggtattagggtcgaattcaatcaggcctacgacatcgagggagtgaccgagaaacttgtgaccaagtgtagccagatgaataggcctctggccggatctgcggccgtgcatatcccgagataccatcatatcacctaccataccaaactttcaaaggaccgggacgagcggcgcgaccacatgtgtctcgtggaagtggtcaaggccgtcgacctcgacacctaccagtgataa

SEQ ID NO: 277 - DNA, 714 bp, Escherichia coli
atgactgccctcactgaaggtgccaagctgttcgaaaaagaaattccgtacatcacagaactggaaggagacgtggagggcatgaaattcattatcaagggcgaaggcacaggcgacgctaccaccggtaccatcaaggccaaatacatttgcacaaccggagatcttcccgtgccgtgggccaccctggtgagcactctgtcttacggcgtccagtgcttcgccaagtacccttcacacatcaaagatttctttaagtcagctatgccagaaggttacacccaagaaaggacaatctcattcgagggagatggcgtgtacaagacacgcgcgatggtcacatacgagagaggaagcatctacaatagggtgaccctgactggtgaaaactttaagaaagatggccatattctccgcaagaatgtggcgtttcagtgcccaccctcaattctgtacattctcccggacaccgttaacaacggaatccgggttgagtttaaccaagcttacgacatcgaaggagtgactgaaaaactggtcaccaaatgtagccagatgaatcggcctcttgccggctctgctgccgtgcatatccctcgctaccatcatatcacctaccataccaagctgtcaaaagacagagacgagagacgggatcacatgtgtcttgtggaggtcgtgaaggccgttgatctcgacacctaccagtgataa

SEQ ID NO: 278 - DNA, 714 bp, Escherichia coli
atgaccgccctcaccgagggagccaagctgttcgaaaaagagatcccttacatcaccgaactggagggggacgtggaagggatgaaattcattatcaaaggcgagggaaccggcgacgccactactgggactatcaaagctaagtacatctgtactaccggtgacctgcctgtcccctgggctacccttgtgtctaccctgtcatatggcgtgcagtgtttcgcaaagtacccgtcacacattaaggacttcttcaaatctgccatgcccgaaggttatacccaagagcggactatcagcttcgaaggcgacggggtgtacaagaccagagccatggtgacctatgagagggggtcaatctacaatcgcgtcaccctcactggcgagaacttcaagaaagacggacacattttgcggaagaacgtcgcattccagtgcccgccttcaatcctgtacattctccccgacactgtcaataacggcatccgcgtggagttcaaccaggcatatgacattgaaggtgtgactgagaaattggtcactaagtgcagccagatgaatcggcctcttgccggaagtgctgccgtgcacatcccgcgctatcaccatatcacctaccatactaagctgagcaaggacagagacgaaaggagggaccatatgtgtctggtggaggtggtcaaagcggtggacctcgacacctatcaatgataa

SEQ ID NO: 279 - DNA, 714 bp, Escherichia coli
atgacagcgttgactgaaggcgccaaactgtttgagaaggaaatcccttacattacagagttggagggagacgtggaagggatgaagttcattatcaagggtgaaggcactggcgatgccaccaccggaaccattaaggccaagtacatctgtactaccggggatctgcctgttccctgggctactctcgtgtctaccctttcttacggtgtgcagtgttttgctaagtacccatcacacattaaggatttcttcaagagtgccatgcccgaaggatacacacaagaaagaacaattagcttcgagggagatggcgtgtacaagacacgcgctatggtgacctacgagaggggatcaatctacaaccgggttacactgaccggagagaactttaagaaggacggacatatcctgcgcaagaacgtcgcttttcagtgtcctccatcgatcctttacatcctccctgacaccgttaacaatgggatccgcgtcgagttcaatcaggcgtacgacattgagggagtcaccgagaagctcgtgaccaagtgcagtcagatgaatcgcccacttgccggatctgcggccgtgcacatcccccggtaccaccacatcacttaccataccaagctgagcaaggaccgcgatgagcggagggaccatatgtgcctggtggaagtcgtcaaagccgtcgatcttgacacctaccagtgataa

SEQ ID NO: 280 - DNA, 714 bp, Escherichia coli
atgaccgcactgacagaaggagccaaactgttcgaaaaagaaattccgtacatcacagaattggagggggatgtcgaagggatgaagtttatcatcaaaggagagggaaccggagacgctaccaccggaacaatcaaagccaagtatatctgcaccaccggagatctgcctgtgccctgggccactctggtcagtacactgtcatatggagttcagtgttttgcaaagtatcctagtcacatcaaggatttctttaagtctgcaatgcccgaaggatatacccaagaaaggactatttcattcgagggtgatggagtttacaaaaccagggccatggtgacctacgagcggggatccatctataaccgcgtgactctcactggagaaaacttcaaaaaggacgggcacatcctgcgcaaaaacgtggcctttcaatgcccaccctccattctttacatcttgccagatacagttaacaatggtattagagtcgaattcaatcaggcctatgacattgaaggggtgactgagaagcttgtcacaaagtgcagccagatgaatcgcccgctcgctggatctgctgccgtgcatattcctcgctaccatcatatcacataccatacaaaactctcaaaggaccgcgacgaacggcgggaccatatgtgtctggtggaggtggtgaaggccgtggatctcgacacttaccagtgataa

SEQ ID NO: 281 - DNA, 714 bp, Escherichia coli
atgaccgccctgactgagggagcaaaactgtttgaaaaagagatcccctatatcactgagctcgagggagacgtggagggtatgaagttcattatcaagggagaaggaaccggagacgccactactggaaccatcaaagcgaagtacatttgcaccaccggtgacctgcccgtcccttgggctacccttgtctcaaccctgtcttatggagtgcaatgcttcgcaaagtacccttctcacatcaaagacttcttcaaatcagccatgccggaaggatatactcaagaaaggactatttcatttgaaggagacggtgtctacaaaacccgcgcgatggtcacctacgagcgcggatctatctacaatagagtgaccctcactggagagaacttcaagaaagacggacacattctgagaaagaatgtggcatttcagtgtcctcccagtatcctgtacatcctgcccgacaccgtgaataacggaattcgggtggagtttaaccaggcttatgacattgaaggagtgactgaaaagcttgtgaccaaatgtagccagatgaaccgccctctcgccggaagtgctgctgtgcatatccctcgctatcaccatatcacttatcataccaagcttagcaaggaccgcgacgagaggcgggaccacatgtgcctcgtcgaggtggtgaaggccgtcgacctggacacttaccagtgataa

SEQ ID NO: 282 - DNA, 714 bp, Escherichia coli
atgaccgccctcactgagggagctaaactgttcgagaaagagattccttacatcaccgaacttgaaggagatgtggagggtatgaagttcatcatcaagggagagggaaccggagacgccacaacaggaaccatcaaggccaaatacatttgcacaaccggtgatctgcccgtgccctgggctaccctcgtgtcaacactgtcttacggagttcagtgtttcgccaagtacccttctcacatcaaagacttcttcaaaagcgccatgcctgaaggttacacccaagagcgcaccatttcgttcgagggtgacggtgtgtacaagacccgggccatggtgacctacgaaagggggtcaatctacaaccgcgtcactctgacaggagaaaacttcaaaaaggacggtcatatcctgagaaagaatgttgccttccagtgcccacccagcatcctctacatcctgccagacactgtgaacaacgggatccgggtcgaattcaatcaggcttacgatatcgagggagtgaccgagaagctcgttactaagtgcagccagatgaatcgcccacttgccggttccgctgctgtccatattcctcgctaccatcacattacctaccacaccaagctctccaaagatcgggatgaaagaagggaccacatgtgtcttgttgaggtcgtgaaagccgtggacctggatacataccaatgataa

SEQ ID NO: 283 - DNA, 714 bp, Escherichia coli
atgactgccctgaccgaaggagccaagctgttcgagaaggaaatcccctatatcaccgaacttgagggcgatgtggagggcatgaagttcatcatcaagggagagggaactggcgacgcaacaactggaacaatcaaggccaagtacatttgcacaaccggtgacctgcccgtcccttgggccacacttgtgtcaaccctctcctacggcgtgcagtgtttcgccaagtacccctctcacattaaggatttcttcaagtcagctatgccagagggctacactcaagaaagaaccatctctttcgaaggagatggagtctataagactcgcgctatggtgacctatgagaggggatcaatctacaatcgcgtgacactcaccggagagaatttcaaaaaggacggtcatattcttcggaagaacgtcgctttccagtgtccaccgtccattctgtacatcctgcctgacacagtcaacaacggaatccgcgttgagttcaaccaggcctatgatatcgaaggagtgacagagaagctcgttactaagtgtagccagatgaatcgccctcttgccggttccgccgcagtccacatcccgcgctatcaccacattacatatcataccaaactctcaaaggatcgggatgaaagaagggaccatatgtgccttgtcgaggtggtgaaggcagttgacctggacacctaccagtgataa

SEQ ID NO: 284 - DNA, 714 bp, Escherichia coli
atgaccgcactgacagaaggagccaagctcttcgaaaaggagatcccttacatcaccgaattggaaggtgacgtcgaagggatgaagttcatcatcaagggtgaaggaaccggtgacgcaacaaccgggaccatcaaggccaagtatatctgcacaaccggagacttgcctgtgccctgggctaccctcgtgagcactctgagttatggtgttcagtgtttcgctaagtaccctagccatatcaaagacttcttcaagtcagccatgccagaagggtatactcaagagcgcactatttcattcgaaggagatggagtctataagacaagagccatggtgacatacgaacgcgggtctatctataaccgcgttactctgactggggagaatttcaagaaggatggtcacatccttagaaagaacgtcgctttccagtgtcccccaagcattctgtacattcttcccgacacagtgaacaacgggattagggtggagttcaatcaggcctatgacatcgagggagtgaccgaaaagctcgtgactaaatgcagtcagatgaataggcctcttgcggggtctgcggctgtgcatatcccaagataccatcacattacttaccatacaaagctcagcaaggatcgggatgagcggcgggaccatatgtgccttgttgaagtcgtgaaggcagtcgatctggatacctaccagtgataa

SEQ ID NO: 285 - DNA, 714 bp, Escherichia coli
atgactgcacttactgaaggagcaaagctgtttgaaaaggaaatcccctacattaccgaactggagggagacgtggagggtatgaaattcattatcaagggcgaaggcactggcgacgccaccaccggtaccattaaggccaaatacatttgtaccactggtgacctgcccgtgccctgggctactctcgtgtcaaccctcagctacggagtccagtgcttcgccaagtatccgtcccacatcaaggacttctttaagtcagcaatgcccgagggatatacgcaagaacggaccattagcttcgaaggcgacggcgtctacaagactagggccatggtgacctacgaaaggggctccatctacaatcgcgtcacgctcactggcgagaactttaagaaggacggacacatccttcgcaagaatgtcgcctttcagtgccctccttctatcctctacatccttcccgacaccgtgaacaacggaatccgcgtggaattcaatcaggcttatgacatcgaaggtgtcaccgagaagctggtgaccaagtgtagccagatgaacaggcctcttgctggctctgctgccgtgcatattcctagatatcatcatatcacctatcataccaagctgtcgaaggaccgggacgagagacgggaccatatgtgccttgtcgaagtggtgaaggcagtggacctggacacttatcagtgataa

SEQ ID NO: 286 - DNA, 714 bp, Escherichia coli
atgactgccctgactgaaggcgctaagctgttcgagaaagaaattccctacatcactgagctggaaggtgacgtcgaagggatgaagttcattatcaaaggggagggaactggagacgccaccaccggtaccattaaggccaagtacatctgcaccaccggggacctgcccgtgccttgggccaccctcgtgtcaacccttagttacggagtgcagtgtttcgccaagtacccttcacatatcaaagacttcttcaagtccgccatgcccgaaggatacacccaagaacgcaccatctccttcgagggagacggagtgtacaaaacccgcgccatggtcacctacgagagaggatctatctacaaccgggtgaccctcaccggcgagaatttcaagaaagacggccatatcctgcgcaagaatgtcgctttccaatgccctccgtccatcctctacatcttgcccgacaccgtcaacaacggaatccgcgtggaattcaatcaggcttacgacattgaaggcgtgactgaaaagctggtgaccaaatgcagtcagatgaaccggcctttggctggatctgctgccgtgcacattcctagataccatcatatcacttaccataccaaactcagcaaggaccgcgacgaaaggagggaccacatgtgtctggtggaagtggtcaaagctgtggaccttgacacctaccagtgataa

SEQ ID NO: 287 - DNA, 714 bp, Escherichia coli
atgaccgcccttaccgaaggagccaaactgttcgagaaagagattccttacattaccgaactcgaaggggacgtggaagggatgaagtttatcatcaagggggagggaaccggggacgccactactggtaccatcaaggctaagtacatttgcaccaccggagacttgccggtcccctgggccaccctggtgtcaactctgtcatacggagtccagtgttttgccaagtacccttctcacatcaaggacttcttcaagagcgccatgcctgaggggtacacccaagaaagaaccatttcctttgaaggtgacggtgtgtacaagaccagagctatggtgacctacgagcggggttcaatctacaatagagtgactcttactggggagaactttaagaaggacggacatatcctgaggaagaacgtggctttccagtgtccgccttccatcttgtacattctgcccgacaccgtgaacaacggaatccgcgtcgagttcaatcaggcttacgacattgagggggtgaccgagaagcttgtcaccaagtgcagccagatgaatcgcccgcttgccggatctgccgccgtccacatcccccgctaccatcatatcacttaccacaccaagctcagtaaggaccgggacgaacggagggaccacatgtgcctcgtcgaggtggtcaaggccgtggacctggacacctaccagtgataa

SEQ ID NO: 288 - DNA, 714 bp, Escherichia coli
atgaccgctctcaccgaaggagccaagctttttgaaaaggagatcccctatatcaccgaactcgaaggagacgttgagggtatgaagtttatcattaagggagagggaaccggagacgccaccactggaactatcaaggccaagtacatttgtaccaccggagacttgcccgtgccatgggccactcttgtgtccaccttgtcttacggagtgcaatgttttgctaagtatcctagtcacatcaaggacttcttcaagtcagccatgcctgaaggatatactcaagaacggactatctcctttgagggagacggagtttacaagaccagggccatggtgacctatgagcggggaagcatctacaaccgggtgaccctgaccggagaaaacttcaaaaaggacggtcatattctccgcaagaatgtggcgttccagtgcccaccctcaatcctttacattctgcccgacaccgttaacaatggtatcagggtcgaattcaatcaggcttatgacattgaaggagtgactgagaagctggtgaccaagtgcagccagatgaaccgcccacttgccggttctgccgccgttcacatccctagataccatcacattacttaccacaccaagctgtccaaagacagagacgaacgccgggaccatatgtgtctggtcgaagtggtcaaggcggtcgacctggacacctatcagtgataa

SEQ ID NO: 289 - DNA, 714 bp, Escherichia coli
atgactgccttgaccgaaggcgctaaactgttcgagaaagaaattccttacatcactgaactcgagggcgacgtcgagggtatgaaattcattatcaaaggcgaaggcaccggagacgccacaacaggaactatcaaagccaagtacatctgtaccaccggtgatctgcccgtcccctgggccaccctcgtgtctacactcagctatggtgtgcagtgtttcgccaaatacccgtcacacattaaggatttcttcaagtccgccatgcccgaaggctacacacaagaaaggacaatttcgttcgaaggagacggcgtctacaagaccagagccatggtgacctatgaacgcggcagcatctataaccgggtgaccctgaccggagaaaacttcaagaaggacggacacattctgcgcaagaacgtggcgttccagtgccctccttctatcctgtacattctgcctgatacagtgaataacggcatccgggtggaattcaatcaggcttacgatatcgagggagtcaccgaaaagttggtcactaaatgcagccagatgaatcgcccccttgcgggttccgccgctgtacatattccccgctatcatcatatcacctatcacactaaactgtcaaaggacagggacgagagacgcgaccacatgtgcctcgtggaggtcgtgaaggctgtagatcttgatacctatcagtgataa

SEQ ID NO: 290 - DNA, 714 bp, Escherichia coli
atgaccgcactgactgaaggagccaaactgttcgagaaggagatcccatacattaccgagctcgaaggggacgtggagggtatgaaattcattatcaagggagaggggaccggcgacgcaactaccggcactatcaaggccaaatacatttgtactactggtgaccttcccgtcccttgggccaccctcgtgtccaccctcagctacggtgtccagtgttttgccaaataccctagccatatcaaggacttctttaagtccgctatgcctgagggatacactcaagagcgcactatctctttcgagggggacggcgtgtacaaaacccgggccatggtcacctacgagagaggcagcatctacaatagggttactctgactggcgaaaactttaagaaagacggacatattctccggaagaacgtcgcttttcagtgcccaccatcaatcctgtacatccttcccgacaccgtgaataacgggattcgcgtggaattcaatcaggcttacgacattgagggggtcactgaaaaactggttaccaagtgcagtcagatgaaccgcccccttgccggctctgcagccgtgcacatccctcgctaccatcacatcacctaccataccaagctgtcaaaagacagggacgaacggcgcgaccatatgtgcctggttgaagtggtgaaggcggtggacctggacacctaccagtgataa

SEQ ID NO: 291 - DNA, 714 bp, Escherichia coli
atgactgctcttacagagggggccaagcttttcgagaaggaaatcccttacatcactgaactggagggagatgtcgagggtatgaagttcatcattaagggcgagggaactggagacgcgacaacaggaaccattaaggccaagtatatctgtaccaccggtgatctgccggtcccttgggccaccctggtgagcaccctttcatatggagtgcagtgcttcgcgaaatacccgtcccatatcaaggatttcttcaaatctgctatgcctgaaggctatacccaagagaggactatttccttcgagggagacggagtgtacaagacccgcgctatggtcacatacgaacgcggatcaatctataacagggtgacactcaccggggaaaacttcaagaaggacggccatatcctgcggaagaacgtggctttccagtgcccgccctctattctctacatccttcccgacacagtgaacaatgggattagagtcgagttcaatcaagcctatgacattgaaggagtgaccgaaaagctcgtgaccaagtgcagtcagatgaatagacccctcgccggctcagcggccgtgcatattccccgctaccaccatatcacctatcacactaagctttcaaaggatcgggatgagcggagggaccatatgtgtctggtggaggtggtgaaggccgtcgacctggatacctaccagtgataa

SEQ ID NO: 292 - DNA, 714 bp, Escherichia coli
atgacagcactgaccgaaggtgccaagctgttcgaaaaagaaatcccttacatcaccgaactggaaggagacgtcgaagggatgaagttcatcatcaagggagagggaaccggagacgccactactggaacaatcaaagccaagtacatctgtacaacaggggacctccccgtgccttgggcaactctcgtgagcactctcagttacggagtccagtgtttcgccaaatacccctcacacattaaggatttcttcaagtcagcaatgcccgagggatacacacaagagagaaccatttcattcgaaggggatggagtctacaagactagggccatggtgacatacgagcggggatctatctacaatcgcgtcaccctcaccggagaaaacttcaagaaagacggtcatattctgcgcaaaaacgtcgccttccagtgccctccttctattctgtacatccttcccgataccgtgaacaacggaattcgggtagagttcaatcaggcttacgatattgagggagtgacagaaaagcttgtcactaaatgcagccagatgaatcgccctcttgccgggtctgctgccgtgcatattccgaggtaccaccacatcacataccacaccaagctgagtaaagatagagacgaacggcgggatcatatgtgtctggtggaagtggtaaaagctgtggacctcgacacctaccaatgataa

SEQ ID NO: 293 - DNA, 714 bp, Escherichia coli
atgaccgcactgactgagggagctaaactcttcgaaaaagaaatcccctacatcaccgagctcgagggagacgttgagggtatgaagttcattatcaaaggagaaggaaccggtgacgccaccaccggtaccattaaggcgaaatacatttgcaccactggagacttgcccgttccgtgggccactctggtcagcactctgtcatacggagtccagtgtttcgccaagtacccatcacatatcaaagacttcttcaagtccgctatgcctgaaggatacactcaagaacgcactatctctttcgaaggagacggagtgtacaagaccagagccatggtgacctacgagagaggatcaatctacaatcgggtcacccttaccggagagaacttcaagaaggacggacatattctgaggaaaaacgtcgctttccagtgtcctccatccattctttacatcctgcctgacaccgtgaacaacggaatcagggtggagttcaatcaggcatacgacatcgagggagtcactgaaaaactcgtgaccaagtgcagccagatgaatcggccgttggcaggatctgccgcggtgcatattccgagataccatcacattacttaccacactaagctgtcaaaggaccgggacgagcgccgcgaccatatgtgtctcgtggaggtggtgaaagctgttgacctggacacttaccagtgataa

SEQ ID NO: 294 - DNA, 714 bp, Escherichia coli
atgacagccctgaccgaaggagctaaactgtttgagaaggagattccgtacattaccgagctcgaaggagacgtggaggggatgaagttcatcatcaaaggagagggaaccggtgacgccacaaccggtaccattaaggctaagtacatctgcaccaccggagacttgcccgtcccttgggccacactggtgagcaccctctcatatggagtgcagtgttttgccaaatacccttcacatatcaaggacttctttaagtctgccatgcccgaagggtatacacaagaacggactatttcatttgagggtgatggagtgtataagacccgcgctatggtcacatatgaacggggttcaatctacaatagggtcactctcaccggagagaatttcaagaaggacggacatattctgcgcaaaaacgtggccttccagtgcccgcctagcatcctttacatcttgcctgataccgtgaacaacggtatccgcgtggagttcaatcaggcttacgatattgagggtgtgaccgaaaaactcgtgactaaatgtagccagatgaacagacccctggccggttcagctgccgtccacatcccgcgctaccatcacatcacctatcatacaaaactgtctaaggacagggatgaacgccgggatcatatgtgtcttgtggaggtcgtgaaagccgtcgacctggatacttatcagtgataa

SEQ ID NO: 295 - DNA, 714 bp, Escherichia coli
atgacagcattgaccgagggagccaaactgttcgagaaggagattccttacatcactgagctggagggtgacgtggagggtatgaagttcattatcaaaggcgaaggaaccggcgatgctacaacaggaacaatcaaggccaagtacatctgcactaccggagatcttcctgtgccctgggccacacttgtctctacactcagctacggcgtgcagtgcttcgcaaagtacccttcgcacatcaaggacttcttcaagtctgctatgcctgaaggctacacccaagaacgcacaatttcatttgagggtgatggagtgtacaagactcgcgccatggtgacttacgaacggggatcaatctacaatcgggtcactctgactggagaaaactttaagaaggacggacatattctgcggaagaacgtcgcctttcagtgtcccccgtcgattctctacattttgcccgatacagtgaataacggaatcagggtggagtttaaccaagcctacgatatcgagggagtgaccgaaaagctggtgaccaagtgtagccagatgaataggccccttgctggcagtgccgcagtgcatatccctagataccatcacatcacctaccataccaagctgtctaaggaccgcgacgagaggagagatcatatgtgcctcgtggaagtcgtcaaggccgtggaccttgacacctaccagtgataa

SEQ ID NO: 296 - DNA, 714 bp, Escherichia coli
atgaccgcactcacagagggagcaaagctctttgagaaagaaattccttacattactgaactggagggagacgtggagggtatgaagttcatcatcaagggggaagggactggggatgctaccactggtactatcaaggcgaagtacatttgtacaacaggggacctgcctgtcccctgggcgactctcgtctctacactttcatacggggtgcagtgcttcgccaagtacccgtcccatatcaaagatttctttaagtccgccatgcccgaaggatacacccaagagcggactatctcatttgaaggggatggagtgtacaagacccgcgcaatggtaacctacgaacgcgggtcaatctacaatcgcgtgactctgacaggtgaaaacttcaagaaggatggtcatattctgcgcaagaatgtcgcctttcagtgtccgcctagcatcctttacatcctgccggataccgtgaacaacggtatcagagtggaattcaaccaggcttacgacattgaaggagtcacagagaagcttgtaaccaagtgcagccagatgaataggcccctggctggatctgctgccgtgcacatccctcgctaccaccacattacataccataccaagctttcaaaggatcgggacgaaagaagggaccacatgtgtcttgtggaagtggtgaaggccgtcgacctcgacacctaccaatgataa

SEQ ID NO: 297 - DNA, 714 bp, Escherichia coli
atgaccgcacttaccgaaggcgccaagctgttcgaaaaggaaatcccgtacatcactgaactggaaggtgacgtggagggtatgaagttcattatcaagggagaaggcaccggcgacgctaccactggcacgattaaggcaaagtacatttgtaccaccggagacttgccggtcccatgggccacgcttgtttcaaccttgtcatacggtgtgcagtgcttcgcaaagtacccaagccacatcaaggacttcttcaaatcagccatgccggaaggatacacccaagagcggactatttctttcgagggtgacggcgtctacaagactagagccatggtgacctacgagaggggctctatctacaaccgggtcactcttactggcgagaacttcaagaaagacggacatatcctgcggaagaacgtggcattccagtgccctcccagcatcctctacattctccctgacaccgtgaacaatggcattcgcgtggaattcaatcaggcttacgacatcgaaggagtgaccgagaagctggtgactaagtgcagccagatgaataggccccttgccggatcagctgccgttcatatccctcgctaccaccacattacctaccataccaagctgtcaaaggaccgcgacgaacgccgcgaccacatgtgtctcgtggaagttgtcaaggctgttgacctcgacacttaccaatgataa

SEQ ID NO: 298 - DNA, 714 bp, Escherichia coli
atgaccgccctgaccgaaggagctaagctgtttgaaaaagaaattccatacatcaccgagctggagggagacgtcgagggcatgaagttcatcatcaaaggagaaggcaccggtgacgctaccactggaaccatcaaagctaagtatatctgtaccaccggggaccttcctgtcccctgggccacccttgtgtcaaccctcagttacggggttcagtgctttgccaagtacccctcacatatcaaggacttcttcaagtcagccatgccggaaggctacacccaagaacgcaccatttcgtttgaaggcgacggagtctacaaaactagggctatggttacctacgaaaggggtagtatctataaccgggtgactctcactggagaaaacttcaagaaggacgggcacatcctccgcaagaatgtcgccttccagtgcccgccatctattctgtatatcctgcccgacaccgtgaataacggaattagggttgagtttaaccaggcctatgacattgagggagtgaccgaaaaactggtgaccaaatgcagccagatgaatagacctcttgccggatcagccgctgtccacattcctcggtatcaccatatcacttaccataccaaactgtctaaagaccgggacgaaagacgcgaccacatgtgtctggtggaggtggtgaaggctgtcgacctcgacacttatcagtgataa

SEQ ID NO: 299 - DNA, 714 bp, Escherichia coli
atgaccgccctgaccgaaggagccaagctgttcgagaaggagatcccttacattaccgaactggagggggacgtcgagggtatgaagttcatcatcaaaggggaggggaccggtgacgctaccactgggaccattaaggccaagtatatctgtactaccggggaccttcccgtgccctgggccacccttgtgtcaaccctgtcatacggagtgcagtgcttcgccaagtaccccagccatatcaaggacttcttcaagagtgccatgcctgaaggatatacccaagaacggaccatttcgttcgagggtgacggagtgtataagaccagggccatggtgacctatgagcgcgggtctatctacaacagagttaccctcactggagagaatttcaagaaagacgggcatattcttcgcaagaacgtggccttccagtgcccaccatctattctgtacattcttcctgacaccgtgaataacggtatcagggtcgaattcaatcaggcttacgacatcgaaggagttactgaaaagctcgttactaagtgcagccagatgaacagaccactcgccggaagtgccgctgtgcacattcctcgctatcaccatatcacttaccataccaagctcagcaaggaccgcgacgagcggcgcgaccatatgtgtctggtggaggtcgtgaaggctgtcgaccttgacacctatcaatgataa

SEQ ID NO: 300 - DNA, 714 bp, Escherichia coli
atgaccgcactcaccgaaggcgctaagctgttcgaaaaggaaattccctacattaccgaacttgagggtgacgtcgagggcatgaagtttatcatcaagggggagggaaccggagacgccactactggcaccattaaggcaaagtacatctgcaccactggcgacctccccgtgccttgggcaaccctcgtttctaccctgtcctatggagtgcagtgctttgccaagtatcctagccatatcaaggacttctttaagtctgctatgcctgagggctatactcaagagagaactatcagtttcgagggggatggagtctacaaaacccgggccatggtgacctacgagcgggggtcaatctacaatagggttaccctgactggcgaaaacttcaagaaggatgggcatattctgaggaagaacgttgcctttcagtgtcccccttccatcctgtacattcttccggacaccgtgaataacggtatccgcgtggagttcaatcaggcttacgatatcgagggggtcaccgaaaagctggtgaccaaatgtagccagatgaaccgcccgctggctggttcagccgccgtgcatatcccgcggtatcaccatatcacctatcacactaagttgtccaaggatcgcgacgaacgccgcgatcatatgtgcctcgttgaggtggtgaaggcagtcgacttggatacctatcagtgataa

SEQ ID NO: 301 - DNA, 714 bp, Escherichia coli
atgaccgccttgaccgagggagccaaacttttcgagaaggaaatcccgtacattaccgagctggaaggagacgtcgaagggatgaaattcatcatcaaaggagaaggaaccggagacgcaacaaccggaactatcaaagccaagtatatctgcaccactggagacttgcctgtgccatgggctaccctcgtgtcaactctctcatacggagtgcagtgtttcgccaaataccccagccatatcaaggacttcttcaagtctgcaatgccagaaggttatactcaagagaggaccatttccttcgagggtgacggagtgtacaagacccgcgcaatggtgacatatgaaaggggatcgatctataacagagtaacacttaccggggagaatttcaaaaaggacgggcacatccttcggaagaacgtcgctttccagtgccctccgtccattctgtacatcctgcccgacacagtcaacaatgggatcagagtggagttcaaccaagcctacgacattgaaggtgtaacagagaagctggtgaccaagtgcagccagatgaatagaccgctcgccggatctgctgcagtgcatattcctcggtaccatcacattacttatcatacaaaactgagcaaagaccgcgacgagcggcgcgaccatatgtgtctggtcgaggtcgtcaaggctgtggaccttgacacctatcagtgataa

SEQ ID NO: 302 - DNA, 714 bp, Escherichia coli
atgactgctctgaccgagggagctaaactctttgaaaaagaaattccttacatcaccgaactggaaggagacgtggagggtatgaaattcatcattaagggagaaggaactggagacgccaccactggaaccatcaaggccaagtacatttgtaccaccggtgatcttcccgttccctgggctacccttgtctccaccctgtcttacggagtgcaatgctttgccaaataccccagccacatcaaagatttcttcaagtcagctatgcctgaaggatacacccaagaaagaaccatcagctttgagggagacggagtctacaagaccagagccatggttacttacgagaggggatccatctacaatagggtgactctgactggagaaaacttcaagaaggatggacacatcctgcggaagaacgtcgcttttcagtgtcctcctagcattctctacatccttccggacactgtgaataacggaattcgcgttgagttcaaccaggcctacgatatcgagggagtgactgaaaaacttgtcaccaaatgcagtcagatgaatcggccgctcgccggttctgccgctgtgcatatcccgcgctaccatcacatcacttaccacaccaaactgtcaaaggaccgcgacgaaaggcgggatcatatgtgcctcgtggaagtggtcaaggccgtggaccttgatacttaccagtgataa

SEQ ID NO: 303 - DNA, 714 bp, Escherichia coli
atgaccgcactcaccgaaggagccaagctgttcgagaaggaaatcccttacattacagaactcgagggagacgtggagggtatgaagttcattatcaagggtgaaggaaccggtgacgccactactggtactatcaaggccaagtacatctgcaccaccggtgaccttcccgtgccttgggccacacttgtctcaaccctctcctacggagtgcagtgtttcgccaagtacccaagtcatatcaaggacttcttcaagtcagctatgcccgagggttatacacaagagaggaccatctctttcgaaggagacggagtgtacaaaacccgggccatggtgacatatgaacgcggatcaatctataaccgcgtgacccttactggtgaaaacttcaagaaggacgggcacattctgcgcaagaatgtggccttccagtgtcctccttctatcctgtacatcctgccagacaccgtgaacaacggaattagggtcgaattcaatcaggcatacgacattgaaggagtgacagaaaagctggtgaccaagtgcagccagatgaatagacccctcgccgggtcagctgctgtccacattccacggtatcaccacatcacttatcatacaaagctgtccaaggaccgcgacgaacggcgcgaccatatgtgcctggtggaggtcgtcaaagcagtggacctggacacctatcagtgataa

SEQ ID NO: 304 - DNA, 714 bp, Escherichia coli
atgacagccctcactgaaggcgccaaactgttcgaaaaagagattccatacatcacagagcttgagggagacgtggagggcatgaagttcattatcaagggagaaggtaccggagacgctactaccggcaccattaaggccaaatacatctgtactacaggcgaccttcccgtgccttgggccacactcgtgtcaaccctcagttacggagtgcagtgcttcgcgaaatacccctctcatatcaaggacttcttcaaaagtgctatgccggagggatacacccaagagcgcacaatctcattcgagggcgacggcgtgtacaagacaagagccatggtcacttacgagcgcggttctatctacaacagggtcaccctgaccggagaaaacttcaaaaaggacggccacatccttcgcaagaatgtggcgttccaatgccctccttcaatcctgtacattctgccagacactgtgaacaatggtattcgcgtcgagttcaaccaggcttacgacatcgagggcgtgactgaaaagctggtcacaaaatgtagccagatgaatcgcccccttgccggttctgctgccgtacatattccgcggtaccaccatatcacctaccataccaagctgagcaaagacagggacgaacggcgggaccatatgtgtcttgtggaagtcgtcaaggctgtagacctggacacataccagtgataa

SEQ ID NO: 305 - DNA, 714 bp, Escherichia coli
atgacagcacttactgaaggagctaagctgttcgagaaagaaattccatacatcaccgaactggagggcgacgtggaagggatgaagtttatcatcaagggagaaggaaccggcgacgccactacaggcactatcaaagctaagtatatctgtaccaccggcgacctgcctgtgccatgggcaacactggtgtcaaccctctcttatggtgtccagtgctttgccaaatacccaagccacatcaaggactttttcaagtcagccatgcctgagggatacacccaagaaaggacaatctcattcgaaggagacggggtctataagaccagagccatggtgacctatgaacgcggatcaatctacaatagagtgaccctgaccggggagaacttcaagaaagacggacatatcctgaggaagaacgtcgcctttcagtgtcccccttctattctttacattcttcctgacacagtcaataacggtattcgcgtggaattcaatcaagcctatgacattgagggagtcaccgaaaagttggtgactaaatgcagccagatgaaccggcccctcgctggatcagccgcggtgcatatcccccggtatcaccatatcacctaccacacaaaacttagcaaagaccgcgacgagcgccgggaccacatgtgtttggtggaagtggtcaaagcagtggacctcgacacctaccagtgataa

SEQ ID NO: 306 - DNA, 714 bp, Escherichia coli; identical to SEQ ID NO: 305

SEQ ID NO: 307 - DNA, 714 bp, Escherichia coli
atgaccgccttgactgaaggagcgaagctgttcgaaaaggagattccctacattactgaactcgagggagacgtcgaagggatgaagtttatcatcaagggggagggtacaggggacgccactactggtaccatcaaggctaagtacatttgtaccaccggggacctgcctgtgccctgggccaccctggtgtcaacactcagttacggggtgcagtgctttgccaagtacccatctcacattaaggactttttcaagtcggccatgcctgagggttacacacaagagcgcacaatctcttttgaaggagacggagtgtacaagacccgggccatggtgacatacgaaaggggtagcatctacaaccgggtgacacttaccggagagaatttcaagaaggacggacacatcctgcgcaagaacgtggctttccagtgccctccctcaatcctttacatcctcccagacacagtgaacaatgggatccgcgtcgaattcaatcaggcctacgacatcgaaggagtgactgaaaaactcgtgacaaagtgcagccagatgaacagaccgctggcggggtctgctgcggtgcatattccgaggtaccaccatatcacttaccataccaagctgtcgaaagaccgcgacgaaagacgcgaccacatgtgtctggtcgaagtcgtcaaggctgtggacttggacacctaccagtgataa

SEQ ID NO: 308 - DNA, 714 bp, Escherichia coli
atgactgccctgaccgaaggagccaagctgtttgagaaggagatcccctacatcactgagctggagggcgacgtggagggtatgaagttcatcattaagggagagggaaccggagacgccacaaccggaactatcaaggccaagtacatttgtacaacaggcgaccttcccgtaccttgggccactctcgtgtctaccctctcctacggagtgcagtgtttcgctaagtacccctcccacattaaggacttctttaagtctgccatgccagaaggatacactcaagaacgcactatctcatttgaaggagacggcgtgtacaagacccgcgccatggtgacatacgagcggggatcaatctacaatagagtcacactgaccggagaaaacttcaagaaagacggacatatcctgaggaagaatgtggctttccagtgcccaccaagcattctctacatcctccctgacaccgtcaacaacggtatccgcgtggagtttaaccaggcctacgacattgaaggcgtgactgaaaagctggtcaccaagtgtagccagatgaataggcctcttgccggctcagccgctgtccatatccctagataccatcacatcacataccatacaaagctgtcaaaggaccgggacgagagacgggaccatatgtgcctcgtagaggtggtgaaagctgtcgacctggacacctaccagtgataa

SEQ ID NO: 309 - DNA, 714 bp, Escherichia coli
atgaccgccctcaccgagggagcgaagctgttcgaaaaggaaattccctacatcaccgaactcgagggtgatgtcgaggggatgaagttcatcattaagggagagggaaccggagacgccactacgggaaccattaaggctaagtacatttgtaccactggggacctgcccgtgccttgggcgaccctcgtgtcaaccctttcatacggtgttcagtgcttcgctaagtacccttctcatatcaaagatttcttcaagtcagccatgcccgaaggttacactcaagagcgcaccatcagcttcgagggagacggagtctacaagaccagagccatggtgacttacgaaagggggagcatctacaatagggttactcttactggagagaatttcaagaaggatggacacatcctgcggaaaaacgtggccttccagtgtcctccgtcaatcctgtacatcttgcccgacacggtcaacaacggaattcgggttgagttcaatcaggcctacgacatcgagggggtgaccgagaagctggtgactaagtgcagccagatgaaccggcccctggctggatcagccgccgtgcatattcctcgctaccatcacatcacttaccataccaagttgtctaaggatagagacgaacgcagggatcatatgtgcctggtggaagtggttaaggctgtcgacctcgatacctaccagtgataa

SEQ ID NO: 310 - DNA, 714 bp, Escherichia coli
atgaccgcactgaccgagggagccaaactgtttgaaaaggaaatcccctatatcactgagcttgaaggggacgtggagggtatgaagtttatcattaagggagaggggaccggtgacgccaccaccggaaccatcaaggccaaatacatctgtactaccggagatcttcctgtcccgtgggctaccctggtgtcaaccctcagttatggtgtccaatgcttcgcaaagtatcctagccacattaaggactttttcaaatctgccatgcccgagggatacacccaagagaggaccatctcgtttgagggagatggagtctacaaaaccagagctatggttacctacgaaagaggatcaatctacaatcgggtgaccctgactggtgaaaacttcaagaaggacggtcatatcctgcgcaaaaacgttgcattccagtgtcccccttcaattctttacatccttcctgacactgtgaacaatgggattcgcgtggaattcaaccaggcttatgacatcgagggagtgaccgaaaaactcgtgaccaagtgcagtcagatgaatcgccctctcgcgggttcagccgccgtgcatattccccgctatcatcacatcacttaccatactaagctctctaaagatagggacgagcggcgcgatcatatgtgccttgtcgaggtcgttaaagccgtcgatctggatacctatcagtgataa

SEQ ID NO: 311 - DNA, 714 bp, Escherichia coli
atgaccgcactgaccgaaggcgccaaactgttcgagaaggaaattccttacatcaccgaactggaaggagatgtggagggcatgaagttcatcatcaagggagagggaaccggagatgccactaccggtaccatcaaggccaagtacatctgcaccaccggtgacctcccggttccgtgggccaccctggtgtcgaccctcagttacggagttcagtgtttcgcaaagtacccctctcatatcaaggacttcttcaaatctgccatgcctgaaggctatacccaagaacggactatttcattcgagggagacggagtgtataagactcgcgctatggttacctatgaaaggggaagcatctataacagagtcactcttactggagaaaacttcaagaaggacggacacattcttcggaagaatgtcgcgttccagtgccctccctcaattctgtacatccttccggatactgtcaacaacggcattagagtggaattcaatcaggcttacgatatcgagggtgtgaccgaaaagctggtgaccaagtgtagtcagatgaatagacccctggcgggcagcgccgctgtgcacatccctcgctatcatcacattacctaccacaccaagctcagcaaggacagggacgaacgccgggatcatatgtgtctggtcgaggtggtgaaggcagtggatctcgacacctatcagtgataa

SEQ ID NO: 312 - DNA, 714 bp, Escherichia coli
atgactgcccttaccgagggtgctaagctgttcgagaaagagattccctacatcactgaactggaaggagacgtggagggcatgaagttcatcattaagggcgaaggcaccggggacgcaaccactgggactatcaaggccaagtacatctgtaccaccggcgacctccctgtcccctgggccaccctcgtgtcaaccctctcatacggcgtgcagtgcttcgccaagtacccctcacatatcaaggatttcttcaagtctgcaatgcctgagggttacacccaagaacgcactattagcttcgaaggtgatggagtctacaaaactagagctatggtgacctacgagagggggtcaatctacaaccgggtgaccctgaccggggagaatttcaagaaggacggacatatcctgcggaagaatgtggctttccagtgtcccccttcgattctgtacatccttccagacaccgtcaacaacggcatccgcgtggaattcaatcaggcctacgatatcgagggagtcaccgaaaagctggtgaccaagtgcagccagatgaaccggccacttgctgggtctgcagccgtccacattccacggtaccaccacattacctaccacactaagctgtcaaaggatcgcgacgagagaagggatcatatgtgcctggtggaggtggtgaaggcagtcgatctcgacacctaccaatgataa

SEQ ID NO: 313 - DNA, 714 bp, Escherichia coli
atgaccgcactgaccgagggtgcaaaactgttcgagaaggaaatcccctacattaccgagcttgaaggtgacgtggaggggatgaagtttatcatcaagggagagggaactggagacgccacaacaggaaccattaaggccaaatacatttgcaccaccggggacctgcctgttccttgggctacacttgtcagcactctgtcatacggggtgcagtgctttgccaaatacccttcacacatcaaagactttttcaaatctgccatgcccgaaggatacacacaagaacgcacaatttcattcgaaggagacggagtttacaagactcgcgctatggtcacctacgagaggggatcaatctacaatcgggtgacccttactggagagaacttcaaaaaggacggacatatcctgcggaagaatgtggcattccagtgtccccctagcattctctacatccttcccgacacagtgaacaatggtattagagtggagtttaaccaggcatacgacatcgaaggggtgaccgagaagctcgtgaccaaatgtagccagatgaacaggccgctcgccggatcagccgctgtccacatcccccgctaccatcacattacctaccacaccaagctttctaaggacagagacgagcgccgcgaccatatgtgtctcgtcgaagttgtgaaagctgtggacctggacacttaccaatgataa

SEQ ID NO: 314 - DNA, 714 bp, Escherichia coli
atgactgccctcaccgaaggagccaagctgttcgaaaaagagattccctacatcaccgaactggaaggagacgtggagggtatgaaattcatcattaagggagaaggtaccggagatgctactaccggaactatcaaagccaagtatatctgcaccactggagatcttcctgtgccttgggccaccctggtcagcactttgtcatatggagtccagtgcttcgctaagtacccatctcatatcaaggacttcttcaaatcagctatgcccgaaggatacactcaagaaagaaccatctcattcgaaggagatggagtgtacaagacccgggccatggtcacctatgagcgcggatctatctataaccgcgtgaccctgaccggagagaacttcaagaaggacggacacatcttgcgcaaaaacgtggccttccagtgtcctccaagtattctgtacattcttcccgacactgtgaataacggtattcgggtggagttcaatcaggcctacgacattgaaggagtgactgagaaacttgtgactaagtgcagccagatgaatcgccctcttgctggaagcgctgctgtccatatcccaaggtatcatcatatcacttatcataccaagctgtcaaaagatcgggacgaaaggcgcgatcacatgtgtctcgtcgaagtcgtgaaagccgtggatctcgacacctaccagtgataa

SEQ ID NO: 315 - DNA, 714 bp, Escherichia coli
atgaccgctctgacagagggagcaaagctttttgagaaggaaattccctacattaccgaattggaaggtgacgtggaagggatgaagtttatcatcaagggggaaggtactggagacgccacaaccggtaccatcaaggcaaagtacatctgcactaccggtgacctgcctgtgccctgggccacccttgtgagcactctgagttacggagttcaatgtttcgccaagtacccgtctcatatcaaggacttcttcaaatctgcaatgcccgaaggttacacccaagaaagaactatctcatttgagggagacggagtgtacaagacccgggccatggttacatacgaacgcggatcgatctacaaccgggtgaccctgaccggagagaatttcaagaaggacggacatattctgaggaagaacgtcgcctttcagtgtccgcccagcattctctacatcctcccggacaccgttaacaacggaattagggtcgaattcaatcaggcttacgacattgaaggtgtcacagagaagttggtcacaaagtgcagtcagatgaatagacctctcgccggttctgccgctgtgcacattcctcgctaccaccatatcacctaccatacaaagctctcaaaggaccgcgacgaaaggcgggaccatatgtgcctggtggaggtcgtcaaagccgtggacctggacacttaccagtgataa

SEQ ID NO: 316 - DNA, 714 bp, Escherichia coli
atgaccgctctgacagaaggcgctaaactgtttgagaaagagatcccttacattaccgaattggagggagacgtggagggcatgaaattcattatcaagggcgagggaactggagacgccaccacaggcacaatcaaagccaagtacatttgcacaactggtgacttgcccgtcccctgggctaccctcgtgtcaactcttagctatggagtgcagtgcttcgccaagtacccttctcatatcaaagacttctttaagtcagcgatgcctgaaggatatacccaagagcggaccatctcatttgaaggcgacggcgtctacaaaaccagagccatggtgacatatgagcggggctctatctataacagagtgactcttaccggtgagaacttcaagaaagacggccacattcttcgcaagaacgtggcttttcagtgtcctccttccattctctacatccttcccgacacagtgaacaatggtattcgcgtggaattcaatcaggcttatgacattgagggtgttaccgaaaagctggttacaaagtgtagtcagatgaataggcccctcgccggatcagccgccgtgcatatcccgaggtaccaccacatcacttatcacactaagctgtccaaggaccgggacgaacgccgggaccatatgtgcctggttgaggtcgtcaaagcggtggacctggacacataccagtgataa

SEQ ID NO: 317 - DNA, 714 bp, Escherichia coli
atgaccgcccttactgaaggcgccaagctgtttgagaaagagattccatacatcaccgaactggagggcgatgtggaagggatgaagtttatcatcaaaggcgaaggtactggagacgctactaccggcaccatcaaagctaagtacatttgcactactggggaccttcctgtgccttgggccactctggtgtctaccctgtcttatggtgtgcagtgtttcgccaagtatccgagccacattaaggacttctttaagtcagccatgcctgaagggtatactcaagaaaggactatctcattcgaaggtgatggcgtctacaaaacccgggccatggtgacttacgagagaggaagcatctacaacagggtcaccctcaccggagagaacttcaaaaaggatgggcatattctgcggaagaatgtcgctttccagtgcccgccgtcaattctgtacatccttcccgataccgtgaacaatgggattcgcgtggagtttaaccaggcctacgacatcgaaggagtcactgaaaaactcgtcaccaagtgtagtcagatgaatcgcccccttgccggcagtgctgccgtccatattccacgctatcaccatatcacctatcataccaaactttctaaagatcgggacgaaagaagagatcatatgtgcctcgtggaagtggtgaaggccgtggacctcgacacctatcagtgataa

SEQ ID NO: 318 - DNA, 714 bp, Escherichia coli
atgaccgcactgaccgaaggagcgaaactgttcgaaaaagagatcccttacattaccgaactcgaaggcgacgttgaggggatgaaattcattatcaagggagaaggcacaggcgacgccacaactggaaccatcaaggctaagtacatctgcacaaccggggaccttcccgtgccctgggccacacttgtttctactctgtcctacggtgtgcagtgcttcgccaaatacccttcacacatcaaagacttcttcaagagcgccatgccggaaggttacacacaagagcggaccatttcgttcgaaggagacggggtctacaagacccgcgcaatggtcacctacgaacgcggaagcatctacaatcgcgtgaccctcaccggcgagaatttcaagaaagacggacacattcttcgcaagaacgttgccttccagtgcccgccctccattctgtacattctgccggacactgtgaataacggaatcagggtggagttcaaccaggcatacgacatcgaaggagttaccgaaaagctcgtcaccaagtgtagccagatgaaccgccctctggctggatctgctgccgtgcatatccctcggtaccatcatatcacttaccataccaaactttcaaaggacagagacgaaaggcgggaccatatgtgtcttgtggaggtcgtgaaagccgtggacctggacacataccagtgataa

SEQ ID NO: 319 - DNA, 714 bp, Escherichia coli
atgactgctctgacagaaggggctaagctgttcgagaaagagattccttacatcaccgaactggaaggggacgtggaagggatgaagttcatcatcaagggagaaggaacaggagacgccacaaccgggactatcaaggccaagtacatttgcaccaccggggacctccctgtgccttgggcgaccctggtgtcaacactctcctatggggtccagtgtttcgccaagtacccctctcatatcaaagacttcttcaagtcagctatgcccgaaggttatactcaagagaggaccatcagcttcgaaggagacggagtgtataagacacgcgccatggtgacttatgagcgggggtccatctataacagggttaccctgacaggagaaaacttcaagaaggacggtcatattctgagaaagaatgtggccttccagtgtccgccctctattctctacatcctccccgacactgtcaacaacggtatcagggtggaattcaatcaggcctatgacattgagggagtcaccgaaaagcttgttacaaagtgcagccagatgaatcggcctctggcgggttcagcggctgtgcatatccctcgctaccatcacattacctaccacactaagctgtcaaaggaccgcgacgagagacgggaccatatgtgccttgttgaagtcgtcaaggccgtcgaccttgacacataccaatgataa

SEQ ID NO: 320 - DNA, 714 bp, Escherichia coli
atgactgctctcactgaaggagccaagctgttcgagaaggaaatcccgtacatcacagagttggaaggagacgtggagggtatgaagttcattatcaaaggagagggaaccggcgacgccacaactggaacaatcaaggctaagtatatctgcaccacaggcgaccttccggtgccctgggctaccttggtgtctactctgtcatatggcgtgcaatgtttcgccaagtacccctcacacatcaaggacttcttcaagagtgccatgcctgaaggctacacacaagaacgcaccattagcttcgagggagacggcgtttacaaaaccagggccatggtcacttacgagcgcggaagtatctataaccgcgtcaccctcactggagagaacttcaagaaggacggtcatattctgcgcaagaatgtcgccttccagtgccctcctagcatcctgtacattctgcccgacaccgtcaacaacggaattagagtggagttcaatcaggcttacgacatcgaaggagtgactgaaaagctcgtgacaaagtgtagccagatgaatcggcctctggccggatctgccgccgtccacattccgaggtatcatcatatcacctatcacacaaagcttagcaaggaccgcgacgagagacgggaccacatgtgcctcgtggaggttgtgaaggccgttgacctggacacctatcagtgataa

SEQ ID NO: 321 - DNA, 714 bp, Escherichia coli
atgactgccctgaccgaaggtgctaagctgtttgagaaggagattccgtacatcaccgagctggaaggagacgtcgaagggatgaagttcatcatcaagggagaaggaaccggagacgctacgactggaaccattaaggccaagtatatctgtaccactggagatctgccagtgccttgggccacccttgtgtcaaccctctcgtatggggtgcagtgttttgctaagtaccctagccacattaaggatttcttcaaatccgccatgccggaaggttatacccaagagcgcaccatttcttttgagggagacggagtgtacaagacccgcgccatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggcgggttcagcggctgtccacattccgcgctaccatcatatcacttatcacactaagctctccaaagaccgcgatgagaggagagatcacatgtgcctggtggaagtggtcaaggccgtcgatctcgatacctatcagtgataa

SEQ ID NO: 322 - DNA, 714 bp, Escherichia coli
atgaccgccctcaccgaaggagctaaactgttcgaaaaagagatcccttacatcaccgagcttgagggggacgtggaggggatgaagttcattatcaaaggagaaggaaccggagacgccaccaccggaaccattaaggccaaatacatttgtaccactggagatctgccagtcccttgggctaccttggtcagtactctgtcatacggggtgcagtgtttcgccaagtacccctcacacatcaaagacttcttcaagtctgccatgcctgagggttacacccaagagaggaccatctccttcgagggtgatggtgtctacaaaacccgcgcgatggtgacctacgagcggggttccatctacaatcgggtcactcttactggagagaacttcaagaaggacggacacatcctccgcaagaatgtggccttccagtgcccacccagcattttgtacattctgcccgataccgtgaacaacggaattcgcgtggagttcaatcaggcatacgatatcgaaggtgtgaccgaaaaacttgtgactaagtgtagtcagatgaaccggccgctggctggttccgcagccgtgcacatcccgagataccatcatatcacttaccacaccaaactttctaaggacagagacgaaaggagagatcatatgtgcctcgtcgaagtggtgaaggcagtggacctggatacctaccaatgataa

SEQ ID NO: 323 - DNA, 714 bp, Escherichia coli
atgaccgccctcactgaaggagcaaagctctttgaaaaagaaatcccttacatcaccgaactcgaaggtgatgtggagggtatgaagttcatcattaagggcgagggaaccggagatgctaccaccggaaccatcaaggccaagtacatttgtaccaccggcgatctgcctgtgccatgggccaccttggtgtctaccttgtcatacggcgtccagtgcttcgctaagtacccctctcatatcaaggacttctttaagtccgcaatgccagaaggatacactcaagagagaaccatttcatttgaaggcgatggagtgtacaagacccgcgccatggtgacctacgaaagaggatccatctacaatcgcgtgaccctcaccggagagaacttcaagaaggatggacacattcttcgcaagaatgtcgcatttcaatgccctccaagcattctgtacattcttcccgacactgtcaacaacggaatccgggtcgaattcaaccaggcctacgacattgaaggcgtgaccgagaagctggtcaccaagtgtagccagatgaataggcctctggcgggtagtgctgccgtgcatatcccccggtaccatcacatcacttaccatactaagctgtcaaaagaccgcgacgagcgcagggaccatatgtgcctggtggaagtcgtcaaggcggtggacctggatacttaccagtgataa

SEQ ID NO: 324 - DNA, 996 bp, Escherichia coli
ttccttgtcttcgcacgaccaggctacaatgaactcgaaacgacgacgagcttcatgcacagtgattccactaatttattccatgtcacacttttcgcatctttgttatgctatggttatttcataccataagaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 325 - DNA, 981 bp, Escherichia coli
ttccttgtcttcgcacgaccaggctacaatgaactcgaaacgacgacgagcttcatgcacagtgccccaggctttacactttatgcttccggctcgtataatgtgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 326 - DNA, 1004 bp, Escherichia coli
ttccttgtcttcgcacgaccaggctacaatgaactcgaaacgacgacgagcttcatgcacagtgataaatgtgagcggataacaattgacattgtgagcggataacaagatactgagcacatcagcaggacgcactgaccgaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 327 - DNA, 996 bp, Escherichia coli
ttccttgtcttcgcacgaccaggctacaatgaactcgaaacgacgacgagcttcatgcacagtgatttaaaatttatcaaaaagagtattgacttaaagtctaacctataggatacttacagccatcgagaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 328 - DNA, 1001 bp, Escherichia coli
ttccttgtcttcgcacgaccaggctacaatgaactcgaaacgacgacgagcttcatgcacagtgtaattcctaatttttgttgacactctatcgttgatagagttattttaccactccctatcagtgatagagaaaagaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 329 - DNA, 1021 bp, Escherichia coli
ttccttgtcttcgcacgaccaggctacaatgaactcgaaacgacgacgagcttcatgcacagtgccacaattcagcaaattgtgaacatcatcacgttcatctttccctggttgccaatggcccattttcctgtcagtaacgagaaggtcgcgtattgaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 330 - DNA, 1010 bp, Escherichia coli
ttccttgtcttcgcacgaccaggctacaatgaactcgaaacgacgacgagcttcatgcacagtgcgaacgatcaaaaataagtgccttcccatcaaaaaaatattctcaacataaaaaactttgtgtaatacttgtaacgctacatgaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 331 - DNA, 1010 bp, Escherichia coli
ttccttgtcttcgcacgaccaggctacaatgaactcgaaacgacgacgagcttcatgcacagtgtttttgaaaccaaatctttatctttgtagcactttcacggtagcgaaacgttagtttgaatggaaagatgcctgcagacacagaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 332 - DNA, 1010 bp, Escherichia coli
ttccttgtcttcgcacgaccaggctacaatgaactcgaaacgacgacgagcttcatgcacagtgtgtaaggtaaaacttatcgatttgataatggaaacgcattagccgaatcggcaaaaattggttaccttacatctcatcgaaagaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 333 - DNA, 1010 bp, Escherichia coli
ttccttgtcttcgcacgaccaggctacaatgaactcgaaacgacgacgagcttcatgcacagtgcgttacaggaaaagccaaagctgaatcgattttatgatttggttcaattcttcctttagcggcataatgtttaatgacgtacgaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 334 - DNA, 1010 bp, Escherichia coli
ttccttgtcttcgcacgaccaggctacaatgaactcgaaacgacgacgagcttcatgcacagtgtagcctgaaggtaatcgtttgcgtaaattcctttgtcaagacctgttatcgcacaatgattcggttatactgttcgccgttggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 335 - DNA, 1010 bp, Escherichia coli
ttccttgtcttcgcacgaccaggctacaatgaactcgaaacgacgacgagcttcatgcacagtggcggacgcagcaaatattgagcaagcgttcaaagccctatgtacagaactcaatgcacaaggcagtattaacgtcgtcaattgaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 336 - DNA, 1010 bp, Escherichia coli
ttccttgtcttcgcacgaccaggctacaatgaactcgaaacgacgacgagcttcatgcacagtgtttcgtctcactgacaataccttgatctacaaactaattaataaatagttaattaacgctcatcattgtacaatgaactgtagaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 337 - DNA, 1010 bp, Escherichia coli
ttccttgtcttcgcacgaccaggctacaatgaactcgaaacgacgacgagcttcatgcacagtgcataatttgtaggaattgatatttatcaatgtataagtcttggaaatgggcatcaaaaagagataaattgttctcgatcaaagaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 338 - DNA, 1010 bp, Escherichia coli
ttccttgtcttcgcacgaccaggctacaatgaactcgaaacgacgacgagcttcatgcacagtgcagaattcgataaatctctggtttattgtgcagtttatggttccaaaatcgccttttgctgtatatactcacagcataactggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 339 - DNA, 1010 bp, Escherichia coli
ttccttgtcttcgcacgaccaggctacaatgaactcgaaacgacgacgagcttcatgcacagtgtgtaagatctcaactatcgcatccgtggattaattcaattataacttctctctaacgctgtgtatcgtaacggtaacactgtgaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 340 - DNA, 1010 bp, Escherichia coli
ttccttgtcttcgcacgaccaggctacaatgaactcgaaacgacgacgagcttcatgcacagtgattgttacacaacactccgggtaatgcattccaatactgtatattcattcaggtcaatttgtgtcataattaaccgtttgtggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 341 - DNA, 1010 bp, Escherichia coli
ttccttgtcttcgcacgaccaggctacaatgaactcgaaacgacgacgagcttcatgcacagtgcattcatttttaagcttgctacgcatgtcacatttaacatggttgcacaaagttgcaacatcatggatatttcacgataacggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 342 - DNA, 1010 bp, Escherichia coli
ttccttgtcttcgcacgaccaggctacaatgaactcgaaacgacgacgagcttcatgcacagtgaaacggctgtaaccgtttccattgctgtgactcgattcacgaagtcctgtattcagtgctgacaaaatagccgccagcaagcgaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 343 - DNA, 972 bp, Escherichia coli
ttccttgtcttcgcacgaccaggctacaatgaactcgaaacgacgacgagcttcatgcacagtgttgacaattaatcatccggctcatagcgtctgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 344 - DNA, 972 bp, Escherichia coli
ttccttgtcttcgcacgaccaggctacaatgaactcgaaacgacgacgagcttcatgcacagtgttgcgtattaatcatccggctcgtataatgtgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 345 - DNA, 971 bp, Escherichia coli
ttccttgtcttcgcacgaccaggctacaatgaactcgaaacgacgacgagcttcatgcacagtgttgaatcttaatcatcggctcgtataatgtgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 346 - DNA, 971 bp, Escherichia coli
ttccttgtcttcgcacgaccaggctacaatgaactcgaaacgacgacgagcttcatgcacagtgttgcctcttaatcatcggctcgtataatgtgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 347 - DNA, 972 bp, Escherichia coli
ttccttgtcttcgcacgaccaggctacaatgaactcgaaacgacgacgagcttcatgcacagtgttgacaattaatcatccggctcgtagggtttgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 348 - DNA, 972 bp, Escherichia coli
ttccttgtcttcgcacgaccaggctacaatgaactcgaaacgacgacgagcttcatgcacagtgttcaaatttaatcatccggctcgtataatgtgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 349 - DNA, 972 bp, Escherichia coli
ttccttgtcttcgcacgaccaggctacaatgaactcgaaacgacgacgagcttcatgcacagtgttcacacttaatcatccggctcgtataatgtgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 350 - DNA, 971 bp, Escherichia coli
ttccttgtcttcgcacgaccaggctacaatgaactcgaaacgacgacgagcttcatgcacagtgttgactattaatcatcggctcatccattatgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 351 - DNA, 972 bp, Escherichia coli
ttccttgtcttcgcacgaccaggctacaatgaactcgaaacgacgacgagcttcatgcacagtgttgacaattaatcatccggctcctagtttctgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 352 - DNA, 972 bp, Escherichia coli
ttccttgtcttcgcacgaccaggctacaatgaactcgaaacgacgacgagcttcatgcacagtgttgatacttaatcatccggctcgtataatgtgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 353 - DNA, 972 bp, Escherichia coli
ttccttgtcttcgcacgaccaggctacaatgaactcgaaacgacgacgagcttcatgcacagtgttgactattaatcatccggctcgtaatatgtgtggaattgtgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 354 - DNA, 994 bp, Escherichia coli
ttccttgtcttcgcacgaccaggctacaatgaactcgaaacgacgacgagcttcatgcacagtgaagaatcataaaaaatttatttgctttcaggaaaatttttctgtataatagattcataaatttgaggaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 355 - DNA, 993 bp, Escherichia coli
ttccttgtcttcgcacgaccaggctacaatgaactcgaaacgacgacgagcttcatgcacagtgaaaaacggattgaccaatttttggcgcagtagtaacgttttgcataatataaactccagtttattgaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 356 - DNA, 992 bp, Escherichia coli
ttccttgtcttcgcacgaccaggctacaatgaactcgaaacgacgacgagcttcatgcacagtgtggatctggtagtctcatagttaatttctcctctttaataacaatattataatagtattggaaagaagactttgtgacggtttccctctagaaataattttgtttaacttttcgagaccttaggaggtaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacataccgttaaggtctcaaaaatgaagtgaagttcctatactttctagagaataggaacttctatagtgagtcgaataagggcgacacaaaatt

SEQ ID NO: 357 - DNA, 947 bp, Escherichia coli
aaatcatgaaaaatttatttgctttgtgagcggataacaattataatatgtggaattgtgagcgctcacaattccacaacggtttccctctagaaataattttgtttaacttttcgagaccttaggaggtaaacatatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaggtaccgaattctgtacaggcctgcagagatctgagctcgctagccgtcgacaagcttgcggccgctaatgactcgagtaagtaactaaggtctcacccc

SEQ ID NO: 358 - DNA, 703 bp, Escherichia coli
aaggaggtaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 359 - DNA, 703 bp, Escherichia coli
atggtggaaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 360 - DNA, 710 bp, Escherichia coli
tagaagataaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 361 - DNA, 703 bp, Escherichia coli
aatgatgtaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 362 - DNA, 710 bp, Escherichia coli
atggtggtaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 363 - DNA, 703 bp, Escherichia coli
tagaaggaaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 364 - DNA, 703 bp, Escherichia coli
aaagagataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 365 - DNA, 703 bp, Escherichia coli
atggaagtaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 366 - DNA, 703 bp, Escherichia coli
taggtggtaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 367 - DNA, 710 bp, Escherichia coli
aagtaggtaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 368 - DNA, 710 bp, Escherichia coli
aaagaggcaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 369 - DNA, 703 bp, Escherichia coli
atggagttaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 370 - DNA, 710 bp, Escherichia coli
taggatgtaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 371 - DNA, 710 bp, Escherichia coli
aaggtggtaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 372 - DNA, 703 bp, Escherichia coli
aagaaggcaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 373 - DNA, 703 bp, Escherichia coli
aatgagttaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 374 - DNA, 710 bp, Escherichia coli
atggatgtaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 375 - DNA, 710 bp, Escherichia coli
taggtggcaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 376 - DNA, 710 bp, Escherichia coli
aagtagttaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 377 - DNA, 710 bp, Escherichia coli
aaagaagtaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 378 - DNA, 710 bp, Escherichia coli
taagagacaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 379 - DNA, 710 bp, Escherichia coli
ttgtaggaaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 380 - DNA, 710 bp, Escherichia coli
attgtggtaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 381 - DNA, 703 bp, Escherichia coli
tattatgtaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 382 - DNA, 703 bp, Escherichia coli
ttgatgataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 383 - DNA, 703 bp, Escherichia coli
ttagtagaaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 384 - DNA, 710 bp, Escherichia coli
ataaaaataaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 385 - DNA, 703 bp, Escherichia coli
aatttgtaaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 386 - DNA, 710 bp, Escherichia coli
aagatagcaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 387 - DNA, 710 bp, Escherichia coli
taggttttaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 388 - DNA, 703 bp, Escherichia coli
atggattcaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 389 - DNA, 703 bp, Escherichia coli
aaagaggtaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 390 - DNA, 703 bp, Escherichia coli
aagtaggaaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 391 - DNA, 703 bp, Escherichia coli
taggagataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 392 - DNA, 703 bp, Escherichia coli
aaagaagtaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 393 - DNA, 710 bp, Escherichia coli
taagaggcaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 394 - DNA, 703 bp, Escherichia coli
aaggaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 395 - DNA, 710 bp, Escherichia coli
aagaaggcaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 396 - DNA, 710 bp, Escherichia coli
tagtaggcaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 397 - DNA, 703 bp, Escherichia coli
aaggttgcaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 398 - DNA, 703 bp, Escherichia coli
taggaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 399 - DNA, 703 bp, Escherichia coli
aaggtaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 400 - DNA, 710 bp, Escherichia coli
aattaggtaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 401 - DNA, 710 bp, Escherichia coli
aaggattaaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 402 - DNA, 710 bp, Escherichia coli
aagaaagcaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 403 - DNA, 703 bp, Escherichia coli
ataatagtaaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 404 - DNA, 710 bp, Escherichia coli
aaggttgaaaaaaataaaaaatggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaatga

SEQ ID NO: 405 - DNA, 724 bp, Escherichia coli
aaggaggtaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 406 - DNA, 724 bp, Escherichia coli
atggtggaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 407 - DNA, 724 bp, Escherichia coli
aaagagataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 408 - DNA, 731 bp, Escherichia coli
aaagaggcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 409 - DNA, 724 bp, Escherichia coli
atggagttaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 410 - DNA, 731 bp, Escherichia coli
atggatgtaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 411 - DNA, 731 bp, Escherichia coli
attgtggtaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 412 - DNA, 731 bp, Escherichia coli
ataaaaataaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 413 - DNA, 731 bp, Escherichia coli
aagatagcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 414 - DNA, 724 bp, Escherichia coli
atggattcaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 415 - DNA, 724 bp, Escherichia coli
aaagaggtaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 416 - DNA, 724 bp, Escherichia coli
aagtaggaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 417 - DNA, 724 bp, Escherichia coli
taggagataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 418 - DNA, 724 bp, Escherichia coli
aaagaagtaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 419 - DNA, 731 bp, Escherichia coli
taagaggcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 420 - DNA, 724 bp, Escherichia coli
aaggaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 421 - DNA, 731 bp, Escherichia coli
aagaaggcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 422 - DNA, 731 bp, Escherichia coli
tagtaggcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 423 - DNA, 724 bp, Escherichia coli
aaggttgcaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 424 - DNA, 724 bp, Escherichia coli
taggaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 425 - DNA, 724 bp, Escherichia coli
aaggtaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 426 - DNA, 731 bp, Escherichia coli
aattaggtaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 427 - DNA, 731 bp, Escherichia coli
aaggattaaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 428 - DNA, 731 bp, Escherichia coli
aagaaagcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 429 - DNA, 724 bp, Escherichia coli
ataatagtaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 430 - DNA, 731 bp, Escherichia coli
aaggttgaaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 431 - DNA, 746 bp, Escherichia coli
gtttaacttttaaggaggtaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 432 - DNA, 746 bp, Escherichia coli
gtttaacttttatggtggaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 433 - DNA, 746 bp, Escherichia coli
gtttaacttttaaagagataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 434 - DNA, 753 bp, Escherichia coli
gtttaacttttaaagaggcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 435 - DNA, 746 bp, Escherichia coli
gtttaacttttatggagttaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 436 - DNA, 753 bp, Escherichia coli
gtttaacttttatggatgtaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 437 - DNA, 753 bp, Escherichia coli
gtttaacttttattgtggtaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 438 - DNA, 753 bp, Escherichia coli
gtttaacttttataaaaataaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 439 - DNA, 753 bp, Escherichia coli
gtttaacttttaagatagcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 440 - DNA, 746 bp, Escherichia coli
gtttaacttttatggattcaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 441 - DNA, 746 bp, Escherichia coli
gtttaacttttaaagaggtaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 442 - DNA, 746 bp, Escherichia coli
gtttaacttttaagtaggaaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 443 - DNA, 746 bp, Escherichia coli
gtttaactttttaggagataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 444 - DNA, 746 bp, Escherichia coli
gtttaacttttaaagaagtaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 445 - DNA, 753 bp, Escherichia coli
gtttaactttttaagaggcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 446 - DNA, 746 bp, Escherichia coli
gtttaacttttaaggaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 447 - DNA, 753 bp, Escherichia coli
gtttaacttttaagaaggcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 448 - DNA, 753 bp, Escherichia coli
gtttaactttttagtaggcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 449 - DNA, 746 bp, Escherichia coli
gtttaacttttaaggttgcaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 450 - DNA, 746 bp, Escherichia coli
gtttaactttttaggaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 451 - DNA, 746 bp, Escherichia coli
gtttaacttttaaggtaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 452 - DNA, 753 bp, Escherichia coli
gtttaacttttaattaggtaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 453 - DNA, 753 bp, Escherichia coli
gtttaacttttaaggattaaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 454 - DNA, 753 bp, Escherichia coli
gtttaacttttaagaaagcaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 455 - DNA, 746 bp, Escherichia coli
gtttaacttttataatagtaaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 456 - DNA, 753 bp, Escherichia coli
gtttaacttttaaggttgaaaaaaataaaaaatgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaaccccaagggcg

SEQ ID NO: 457 - DNA, 569 bp, Encephalomyocarditis virus
aattccgccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaacgtctaggccccccgaaccacggggacgtggttttcctttgaaaaacacgatgataat

SEQ ID NO: 458 - DNA, 9694 bp, Escherichia coli
tcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctctcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcaggccaacatgggctctagcctggacgacgagcacatcctgagcgccctgctgcagagcgacgacgaactggtgggcgaggacagcgacagcgaggtcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccagcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagagtgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacatgcgacaactggttcaccagcatccccctggccaagaacctcctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctcctgtccagctgcgacgaggacgccagcatcaacgagagcaccggcaagccccagatggtgatgtactacaaccagaccaagggcggcgtggacaccctggaccagatgtgcagcgtgatgacatgcagcagaaagaccaacagatggcctatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctccgggacaacatcagcaacatcctgcccaaggaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttctgattcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaagcaggtttaaccctagaaagatagtctgcgtaaaattgacgcatgcattcttgaaatattgctctctctttctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcagatcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggacacgctgtcgaacttttcgatcagaaacttctcgacagacgtcgcggtgagttcaggctttttcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgacctgctatactctggagacggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcggcgtcttcctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatcgcctgctattgtcttgccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacatttgttactttatagaagaaattttgagtttttgtttttttttaataaataaataaacataaataaattgtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgattatctttctagggttaagaagactg

SEQ ID NO: 459 - DNA, 9067 bp, Escherichia coli
tcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctctcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcaggccaacatgggctctagcctggacgacgagcacatcctgagcgccctgctgcagagcgacgacgaactggtgggcgaggacagcgacagcgaggtcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccagcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagagtgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacatgcgacaactggttcaccagcatccccctggccaagaacctcctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctcctgtccagctgcgacgaggacgccagcatcaacgagagcaccggcaagccccagatggtgatgtactacaaccagaccaagggcggcgtggacaccctggaccagatgtgcagcgtgatgacatgcagcagaaagaccaacagatggcctatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctccgggacaacatcagcaacatcctgcccaaggaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttctgattcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaagcaggtttaaccctagaaagatagtctgcgtaaaattgacgcatgcattcttgaaatattgctctctctttctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgacctgctatactctggagacggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcggcgtcttcctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatcgcctgctattgtcttgccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacatttgttactttatagaagaaattttgagtttttgtttttttttaataaataaataaacataaataaattgtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgattatctttctagggttaagaagactg

SEQ ID NO: 460 - DNA, 9268 bp, Escherichia coli
tcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctctcaatattggccattagccatattattcattggttatatagcataaatcaatattggctattggccattgcatacgttgtatctatatcataatatgtacatttatattggctcatgtccaatatgaccgccatgttggcattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcactagaagctttattgcggtagtttatcacagttaaattgctaacgcagtcaggccaacatgggctctagcctggacgacgagcacatcctgagcgccctgctgcagagcgacgacgaactggtgggcgaggacagcgacagcgaggtcagcgaccacgtgtccgaggacgacgtgcagtccgacaccgaggaagccttcatcgacgaggtgcacgaagtgcagcctaccagcagcggctccgagatcctggacgagcagaacgtgatcgagcagcctggcagctccctggccagcaacagaatcctgaccctgccccagagaaccatcagaggcaagaacaagcactgctggtccacctccaagagcaccaggcggagcagagtgtccgccctgaacatcgtgcggagccagaggggccccaccagaatgtgcagaaacatctacgaccccctgctgtgcttcaagctgttcttcaccgacgagatcatcagcgagatcgtgaagtggaccaacgccgagatcagcctgaagaggcgggagagcatgaccagcgccaccttcagagacaccaacgaggacgagatctacgccttcttcggcatcctggtgatgaccgccgtgagaaaggacaaccacatgagcaccgacgacctgttcgacagatccctgagcatggtgtacgtgtccgtgatgagcagagacagattcgacttcctgatcagatgcctgagaatggacgacaagagcatcagacccaccctgcgggagaacgacgtgttcacccccgtgcggaagatctgggacctgttcatccaccagtgcatccagaactacacccctggcgcccacctgaccatcgatgagcagctgctgggcttcagaggcagatgccccttcagagtgtacatccccaacaagcccagcaagtacggcatcaagatcctgatgatgtgcgacagcggcaccaagtacatgatcaacggcatgccctacctgggcagaggcacccagacaaacggcgtgcccctgggcgagtactacgtgaaagaactgagcaagcctgtgcatggcagctgcaggaacatcacatgcgacaactggttcaccagcatccccctggccaagaacctcctgcaggaaccctacaagctgaccatcgtgggcaccgtgcggagcaacaagcgggagatcccagaggtgctgaagaacagcagatccagacctgtgggaacaagcatgttctgcttcgacggccccctgaccctggtgtcctacaagcccaagcccgccaagatggtgtacctcctgtccagctgcgacgaggacgccagcatcaacgagagcaccggcaagccccagatggtgatgtactacaaccagaccaagggcggcgtggacaccctggaccagatgtgcagcgtgatgacatgcagcagaaagaccaacagatggcctatggccctgctgtacggcatgatcaatatcgcctgcatcaacagcttcatcatctacagccacaacgtgtccagcaagggcgagaaggtgcagagccggaagaaattcatgcggaacctgtacatgagcctgacctccagcttcatgagaaagagactggaagcccccaccctgaagagatacctccgggacaacatcagcaacatcctgcccaaggaagtgccaggaacaagcgacgacagcaccgaggaacccgtgatgaagaagaggacctactgcacctactgtcccagcaagatcagaagaaaggccaacgccagctgcaagaaatgcaaaaaagtgatctgccgggagcacaacatcgacatgtgccagagctgtttctgattcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggagatgtgggaggttttttaaagcaagtaaaacctctacaaatgtggtaagcaggtttaaccctagaaagatagtctgcgtaaaattgacgcatgcattcttgaaatattgctctctctttctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgacctgctatactctggagacggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcggcgtcttcctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatcgcctgctattgtcttgccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacatttgttactttatagaagaaattttgagtttttgtttttttttaataaataaataaacataaataaattgtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgattatctttctagggttaagaagactg

SEQ ID NO: 461 - DNA, 8364 bp, Escherichia coli
tcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagatcccgaaccccgcgtttatgaacaaacgacccaacacccgtgcgttttattctgtctttttattgccgtcatagcgcgggttccttccggtattgtctccttccgtgtttcagttagcctcccccatctcccggtcgagaagcttacgcgtgaatttcgacgcggccgcctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccattgcctccgcgaccggctgcagaacagcgggcagttcggtttcaggcagatcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggacacgctgtcgaacttttcgatcagaaacttctcgacagacgtcgcggtgagttcaggctttttcattgtggcggcgacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgggcagagcgcacatcgcccacagtccccgagaagttggggggaggggtcggctgcaggtaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacctgcctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttagcgtgacgtcaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatcgggaattgcgcacgcagtggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 462 - DNA, 7728 bp, Escherichia coli
tcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagatcccgaaccccgcgtttatgaacaaacgacccaacacccgtgcgttttattctgtctttttattgccgtcatagcgcgggttccttccggtattgtctccttccgtgtttcagttagcctcccccatctcccggtcgagaagcttacgcgtgaatttcgacgcggccgcttagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatgacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgggcagagcgcacatcgcccacagtccccgagaagttggggggaggggtcggctgcaggtaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacctgcctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttagcgtgacgtcaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatcgggaattgcgcacgcagtggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 463 - DNA, 7938 bp, Escherichia coli
tcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagatcccgaaccccgcgtttatgaacaaacgacccaacacccgtgcgttttattctgtctttttattgccgtcatagcgcgggttccttccggtattgtctccttccgtgtttcagttagcctcccccatctcccggtcgagaagcttacgcgtgaatttcgacgcggccgctcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcattgtggcggcgacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgggcagagcgcacatcgcccacagtccccgagaagttggggggaggggtcggctgcaggtaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacctgcctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttagcgtgacgtcaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatcgggaattgcgcacgcagtggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 464 - DNA, 7785 bp, Escherichia coli
tcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagatcccgaaccccgcgtttatgaacaaacgacccaacacccgtgcgttttattctgtctttttattgccgtcatagcgcgggttccttccggtattgtctccttccgtgtttcagttagcctcccccatctcccggtcgagaagcttacgcgtgaatttcgacgcggccgcttagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatggtttagttcctcaccttgtcgtattatactatgccgatatactatgccgatgattaattgtcaacagggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttagcgtgacgtcaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatcgggaattgcgcacgcagtggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 465 - DNA, 7785 bp, Escherichia coli; identical to SEQ ID NO: 464

SEQ ID NO: 466 - DNA, 9268 bp, Escherichia coli; identical to SEQ ID NO: 460

SEQ ID NO: 467 - DNA, 4740 bp, Escherichia coli
ctcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaggcgagagtagggaactgccaggcatcaaactaagcagaaggcccctgacggatggcctttttgcgtttctacaaactctttctgtgttgtaaaacgacggccagtcttaagctcgggccccctgggcggttctgataacgagtaatcgttaatccgcaaataacgtaaaaacccgcttcggcgggtttttttatggggggagtttagggaaagagcatttgtcagaatatttaagggcgcctgtcactttgcttgatatatgagaattatttaaccttataaatgagaaaaaagcaacgcactttaaataagatacgttgctttttcgattgatgaacacctataattaaactattcatctattatttatgattttttgtatatacaatatttctagtttgttaaagagaattaagaaaataaatctcgaaaataataaagggaaaatcagtttttgatatcaaaattatacatgtcaacgataatacaaaatataatacaaactataagatgttatcagtatttattatcatttagaataaattttgtgtcgcccttaattgtgagcggataacaattacgagcttcatgcacagtggcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactataggggaaaatcagcctcgactgtgccttctagttgccagccatctgttgtttgcccctcccccgtgccttccttgaccctggaaggtgccactcccactgtcctttcctaataaaatgaggaaattgcatcacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcattaccaatgcttaatcagtgaggcacctatctcagcgatctgtctatttcgttcatccatagttgcctgactccccgtcgtgtagataactacgatacgggagggcttaccatctggccccagcgctgcgatgataccgcgagaaccacgctcaccggctccggatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccatcgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttg

SEQ ID NO: 468 - DNA, 54 bp, Mus musculus
gagggcagaggaagtctgctaacatgcggtgacgtcgaggagaatcctggccca

SEQ ID NO: 469 - DNA, 54 bp, Mus musculus
gagggcaggggaagtcttctaacatgcggggacgtggaggaaaatcccggcccc

SEQ ID NO: 470 - DNA, 57 bp, Encephalomyocarditis virus
tacgctggttactttgcggacctactgattcatgacattgagacaaatccagggccc

SEQ ID NO: 471 - DNA, 57 bp, Foot-and-mouth disease virus
cttttgaactttgatttgctcaagttggcaggagacgttgagtccaaccccgggccc

SEQ ID NO: 472 - DNA, 57 bp, Punta Toro virus
gctaccaacttctcccttttaaaacaagcaggagatgttgaagagaatccagggccg

SEQ ID NO: 473 - DNA, 57 bp, Foot-and-mouth disease virus
ctcctgaacttcgaccttctgaaattggccggcgatgtggagagcaatccaggaccg

SEQ ID NO: 474 - DNA, 54 bp, Tomato aspermy virus; identical to SEQ ID NO: 468

SEQ ID NO: 475 - DNA, 57 bp, Punta Toro virus
gcaactaacttttccctattgaagcaagctggtgatgttgaggaaaatccaggccct

SEQ ID NO: 476 - DNA, 57 bp, Encephalomyocarditis virus
tacgctggatattttgccgatttgctcatccatgacattgaaactaacccaggtcct

SEQ ID NO: 477 - DNA, 9240 bp, Escherichia coli
tcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagatcccgaaccccgcgtttatgaacaaacgacccaacacccgtgcgttttattctgtctttttattgccgtcatagcgcgggttccttccggtattgtctccttccgtgtttcagttagcctcccccatctcccggtcgagaagcttacgcgtgaatttcgacgcggccgcctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccattgcctccgcgaccggctgcagaacagcgggcagttcggtttcaggcagatcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggacacgctgtcgaacttttcgatcagaaacttctcgacagacgtcgcggtgagttcaggctttttcattgtggcggcgacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgggcagagcgcacatcgcccacagtccccgagaagttggggggaggggtcggctgcaggtaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacctgcggggagagacgacacccaagctgtctagagccgccaccatggaattcgctagcattctgaaatgagctgttgacaattaatcatccggctcgtataacggataacaattcccctgtagaaataattttgtttaactttaaattgtggtaaaaaataaaaaatggcgagcttggttaagaaagatatgtgtattaagatgacgatggaaggtactgtgaacggttatcactttaagtgcgttggcgagggtgaaggcaagccgttcgagggcacgcagaacatgcgcactcgtgtcaccgagggcggtccgctgccttttgcattcgacatcctggccccgtgctgtatgtacggctctaagaccttcattaaacacgtgagcggtatcccggattactttaaagagtcctttccagagggcttcacttgggaacgtacccagatttttgaggacggtggtgttctgaccgcgcaccaagacaccagcctggaaggtaattgcctgatctataaagtgaaggttctgggtaccaatttcccggcgaatggtccggtgatgcaaaagaaaaccgcgggttgggagccgtgcgtcgagatgctgtatccgcgtgacggcgtcttgtgtggtcagagcttgatggcgctgaagtgcaccgatggcaatcatctgaccagccacctccgcacgacgtatcgtagccgtaaaccgagcaacgccgttaacatgccggagttccattttggtgaccatcgcatcgaaatcctgaaagctgagcagggcaaattctacgaacaatacgaatcggctgtcgcacgttacagcgatgtgccggaaaaagcgacgtaatgactcgagggatcctgacgtctctaaaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttagcgtgacgtcaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatcgggaattgcgcacgcagtggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 478 - DNA, 8604 bp, Escherichia coli
tcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagatcccgaaccccgcgtttatgaacaaacgacccaacacccgtgcgttttattctgtctttttattgccgtcatagcgcgggttccttccggtattgtctccttccgtgtttcagttagcctcccccatctcccggtcgagaagcttacgcgtgaatttcgacgcggccgcttagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatgacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgggcagagcgcacatcgcccacagtccccgagaagttggggggaggggtcggctgcaggtaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacctgcggggagagacgacacccaagctgtctagagccgccaccatggaattcgctagcattctgaaatgagctgttgacaattaatcatccggctcgtataacggataacaattcccctgtagaaataattttgtttaactttaaattgtggtaaaaaataaaaaatggcgagcttggttaagaaagatatgtgtattaagatgacgatggaaggtactgtgaacggttatcactttaagtgcgttggcgagggtgaaggcaagccgttcgagggcacgcagaacatgcgcactcgtgtcaccgagggcggtccgctgccttttgcattcgacatcctggccccgtgctgtatgtacggctctaagaccttcattaaacacgtgagcggtatcccggattactttaaagagtcctttccagagggcttcacttgggaacgtacccagatttttgaggacggtggtgttctgaccgcgcaccaagacaccagcctggaaggtaattgcctgatctataaagtgaaggttctgggtaccaatttcccggcgaatggtccggtgatgcaaaagaaaaccgcgggttgggagccgtgcgtcgagatgctgtatccgcgtgacggcgtcttgtgtggtcagagcttgatggcgctgaagtgcaccgatggcaatcatctgaccagccacctccgcacgacgtatcgtagccgtaaaccgagcaacgccgttaacatgccggagttccattttggtgaccatcgcatcgaaatcctgaaagctgagcagggcaaattctacgaacaatacgaatcggctgtcgcacgttacagcgatgtgccggaaaaagcgacgtaatgactcgagggatcctgacgtctctaaaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttagcgtgacgtcaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatcgggaattgcgcacgcagtggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 479 - DNA, 8814 bp, Escherichia coli
tcagaattggttaattggttgtaacactgacccctatttgtttatttttctaaatacattcaaatatgtatccgctcatgagacaataaccctgataaatgcttcaataatattgaaaaaggaagaatatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgccacttccgaccatcaagcattttatccgtactcctgatgatgcatggttactcaccactgcgatccccggaaaaacagcgttccaggtattagaagaatatcctgattcaggtgaaaatattgttgatgcgctggcagtgttcctgcgccggttgcactcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactcatgaccaaaatcccttaacgtgagttacgcgcgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttagcccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagatcccgaaccccgcgtttatgaacaaacgacccaacacccgtgcgttttattctgtctttttattgccgtcatagcgcgggttccttccggtattgtctccttccgtgtttcagttagcctcccccatctcccggtcgagaagcttacgcgtgaatttcgacgcggccgctcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcattgtggcggcgacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgggcagagcgcacatcgcccacagtccccgagaagttggggggaggggtcggctgcaggtaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacctgcggggagagacgacacccaagctgtctagagccgccaccatggaattcgctagcattctgaaatgagctgttgacaattaatcatccggctcgtataacggataacaattcccctgtagaaataattttgtttaactttaaattgtggtaaaaaataaaaaatggcgagcttggttaagaaagatatgtgtattaagatgacgatggaaggtactgtgaacggttatcactttaagtgcgttggcgagggtgaaggcaagccgttcgagggcacgcagaacatgcgcactcgtgtcaccgagggcggtccgctgccttttgcattcgacatcctggccccgtgctgtatgtacggctctaagaccttcattaaacacgtgagcggtatcccggattactttaaagagtcctttccagagggcttcacttgggaacgtacccagatttttgaggacggtggtgttctgaccgcgcaccaagacaccagcctggaaggtaattgcctgatctataaagtgaaggttctgggtaccaatttcccggcgaatggtccggtgatgcaaaagaaaaccgcgggttgggagccgtgcgtcgagatgctgtatccgcgtgacggcgtcttgtgtggtcagagcttgatggcgctgaagtgcaccgatggcaatcatctgaccagccacctccgcacgacgtatcgtagccgtaaaccgagcaacgccgttaacatgccggagttccattttggtgaccatcgcatcgaaatcctgaaagctgagcagggcaaattctacgaacaatacgaatcggctgtcgcacgttacagcgatgtgccggaaaaagcgacgtaatgactcgagggatcctgacgtctctaaaactgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttagcgtgacgtcaattcccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatcgggaattgcgcacgcagtggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 480 - DNA, 54 bp, Pichia pastoris
gagggcagaggaagtctgctaacatgcggtgacgtcgaggaaaatcctggccca

SEQ ID NO: 481 - protein, 18 aa, Pichia pastoris
EGRGSLLTCGDVEENPGP

SEQ ID NO: 482 - protein, 19 aa, Encephalomyocarditis virus
YAGYFADLLIHDIETNPGP

SEQ ID NO: 483 - protein, 226 aa, Escherichia coli
MSLSKQVLPRDVRMRFHMDGCVNGHQFIIVGEGAGKPDEGKKILKLRVTKGGPLPFAFDILSSTFTYGNRCFCDYPEDMPDYFKQSLPEGHSWERTLMFEDGGCGTASAHISLDKDCFVHQSTFLGVNFPANGPVMQKKTLNWEPSSELITACDGILKGDVTMFLMLEGGQRLKCQFTTSYKASKAVKMPPNHIIEHVLVKKEDADGFQIQEHAVAKHFTVDVKET

SEQ ID NO: 484 - protein, 226 aa, Escherichia coli
MSLSKQVLPHDVKMRYHMDGCVNGHSFTIVGEGAGKPDEGKKILKLRVTKGGPLPFAFDILSSTFTYGNRCFCEYPEDMPDYFKQSLPEGHSWERTLMFEDGGCGTASAHISLDKDCFVHKSTFHGVNFPANGPVMQKKTLNWEPSSELITACDGILKGDVTMFLMLEGGQRLKCQFTTSYKAKKAVKMPPNHIIEHVLVKKEVADGFQIQEHAVAKHFTVDVKET

SEQ ID NO: 485 - protein, 226 aa, Escherichia coli
MSLSKQVLPHDVRMRFHMDGCVNGHQFTIEGEGAGKPYEGKKILKLRVTKGGPLPFAFDILSSVFTYGNRCFCEYPEDMPDYFKQSLPEGYSWERTLMFEDGGCGCASAHIRLEKDCFIHNSTFLGVNFPANGPVMQKKTLNWEPSSELITACDGILKGDVAMFLLLEGGHRLKCQFTTSYKASKAVKIPPCHIIEHRLVKKEVADGFQIQEHAVAKHFTVQVKEA

SEQ ID NO: 486 - protein, 226 aa, Escherichia coli
MSLSKQVLPRDVRMRFHMDGCVNGHQFTIEGEGAGKPYEGKKILKLRVTKGGPLPFAFDILSSVFAYGNRCFCEYPEDMPDYFKQSLPEGYSWERTLMFEDGGCGAASAHIRLEKDCFIHNSTFLGVNFPANGPVMQKKTLNWEPSSELITACDGILKGDVLMFLLLEGGHRLKCQFTTSYKASKAVKIPPSHIIEHRLVKKEVADGFQIQEHAVAKHFTVQVKEA

SEQ ID NO: 487 - protein, 226 aa, Escherichia coli
MSLSKQVLPRDVRMRFHMDGCVNGHQFTIEGEGAGKPYEGKKILKLRVTKGGPLPFAFDILSSVFTYGNRCFCEYPEDMPDYFKQSLPEGYSWERTLMFEDGGCGFASAHIRLEKDCFIHNSTFLGVNFPANGPVMQKKTLNWEPSSELITACDGILKGDVVMFLLLEGGHRLKCQFTTSYKASKAVKIPPGHIIEHVLVKKEVADGFQIQEHAVAKHFTVDVKET

SEQ ID NO: 488 - protein, 226 aa, Escherichia coli
MSLSKQVLPRDVRMRFHMDGCVNGHQFTIEGEGAGKPYEGKKILKLRVTKGGPLPFAFDILSSVFTYGNRCFCEYPEEMPDYFKQSLPEGYSWERTMMFEDGGCSFASAHIRLEKDCFIHNSTFLGVNFPANGPVMQKKTLNWEPSSELITACDGILKGDVVMFLLLEGGHRLKCQFTTSYKASKAVKIPPGHIIEHVLVKKEVADGFQIQEHAVAKHFTVDVKET

SEQ ID NO: 489 - protein, 226 aa, Escherichia coli
MSLSKQVLPRDVRMRFHMDGCVNGHQFIIEGEGAGKPDEGKKILKLRVTKGGPLPFAFDILSSTFVYGNRCFCDYPEDMPDYFKQSLPEGYSWERTLMFEDGGCGTASAHISLDKDCFVHQSTFLGVNFPANGPVMQKKTLNWEPSSELITPCDGILKGDVTMFLLLEGGHRLKCQFTTSYKASKAVKMPPNHIIEHVLVKKEVADGFQIQEHAVAKHFTVDVKET

SEQ ID NO: 490 - protein, 226 aa, Escherichia coli
MSLSKQVLPHDVKMRYHMDGCVNGHSFTIEGEGAGKPDEGKKILKLRVTKGGPLPFAFDILSSVFTYGNRCFCEYPEDMPDYFKQSLPEGYSWERTLMFEDGGCGTASAHISLDKDCFVHKSTFHGVNFPANGPVMQKKTLNWEPSSELITACDGILKGDVTMFLLLEGGHRLKCQFTTSYKAKKAVKMPPNHIIEHVLVKKEVADGFQIQEHAVAKHFTVDVKET

SEQ ID NO: 491 - protein, 226 aa, Escherichia coli
MSLSKQVLPRDVRMRFHMDGCVNGHQFTIEGEGTGKPDEGKKILKLRVTKGGPLPFAFDILSSVFVYGNRCFCEYPEDMPDYFKQSLPEGYSWERTLMFEDGGCGCASAHIRLEKDCFIHNSTFLGVNFPANGPVMQKKTLNWEPSSELITACDGILKGDVAMFLLLEGGHRLKCQFTTSYKASKAVKIPPCHIIEHVLVKKEVADGFQIQEHAVAKHFTVDVKET

SEQ ID NO: 492 - protein, 226 aa, Escherichia coli
MSLSKQVLPRDVRMRFHMDGCVNGHQFTIEGEGTGKPDEGKKILKLRVTKGGPLPFAFDILSSVFVYGNRCFCEYPEDMPDYFKQSLPEGYSWERTLMFEDGGCGAASAHIRLEKDCFIHNSTFLGVNFPANGPVMQKKTLNWEPSSELITACDGILKGDVLMFLLLEGGHRLKCQFTTSYKASKAVKIPPSHIIEHVLVKKEVADGFQIQEHAVAKHFTVDVKET

SEQ ID NO: 493 - protein, 221 aa, Escherichia coli
MSLSKQVLPRDVKMRYHMDGCVNGHQFIIEGEGTGKPYEGKKTLKLRVTKGGPLPFAFDILSAVFTYGNRCFCDYPEEMPDYFKQSLPEGHSWERTMMYEDGGCGTASAHIRLEKNCFIHNSTFHGVNFPANGPVMQKKTLNWEPSSELITAGDGILKGDVTMFLMLEGGHRLKCQFTTSYKAKKAVKMPPNHIIEHRLVRKEVADAVQIQEHAVAKHFIV

SEQ ID NO: 494 - protein, 233 aa, Escherichia coli
MSSGTLLFEKKIPYITELEGDVNGMKFTIHGKGTGDATVGKVDAKFICTTGDVPVPWATLVSTLSYGVQCFAKYPPELKDFFKSCMPEGYVQERTITFEGDGVFKTRAEVTFENGSVYNRVKLNGQGFKKDGHILRKNVAFQCPPDIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 495 - protein, 236 aa, Escherichia coli; identical to SEQ ID NO: 23

SEQ ID NO: 496 - protein, 233 aa, Escherichia coli
MSSGTKLFEKEIPYVTELEGDVNGMKFTIHGKGTGDATVGTIKAKYICTTGDVPVPWATLVSTLSYGVQCFAKYPPHLKDFYKSAMPEGYVQERTITFEGDGVFKTRAEVTFENGSVYNRVTLTGQGFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 497 - protein, 226 aa, Escherichia coli
MSLSKQVLPRDVRMRFHMDGCVNGHQFTIEGEGAGKPYEGKKILKLRVTKGGPLPFAFDILSSVFTYGNRCFCEYPEDMPDYFKQSLPEGYSWERTLMFEDGGCGAASAHIRLEKDCFIHNSTFLGVNFPANGPVMQKKTLNWEPSSELITACDGILKGDVLMFLLLEGGHRLKCQFTTSYKASKAVKIPPSHIIEHVLVKKEVADGFQIQEHAVAKHFTVDVKET

SEQ ID NO: 498 - protein, 226 aa, Escherichia coli
MSLSKQVLPHDVKMRYHMDGCVNGHSFTIEGEGAGKPDEGKKILKLRVTKGGPLPFAFDILSSVFTYGNRCFCEYPEDMPDYFKQSLPEGHSWERTLMFEDGGCGTASAHISLDKDCFVHKSTFHGVNFPANGPVMQKKTLNWEPSSELITACDGILKGDVTMFLLLEGGHRLKCQFTTSYKAKKAVKMPPNHIIEHVLVKKEVADGFQIQEHAVAKHFTVDVKET

SEQ ID NO: 499 - protein, 233 aa, Escherichia coli
MSSGALLFTKKIPYVTELEGDVNGMKFTIHGKGTGDATTGKVDAKFICTTGDVPVPWATLVSTLSYGVQCFAKYPSELKDFYKSCMPEGYVQERTITFEGDGVFKTRAEVTFENGSVYNRVTLTGQTFKKDGHILRKNVAFQCPPDILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 500 - protein, 233 aa, Escherichia coli
MSSGALLFTKKIPYVTELEGDVNGMKFTIHGKGTGDATTGKVDAKFICTTGDVPVPWATLVSTLSYGVQCFAKYPSELKDFYKSCMPEGYVQERTITFEGDGVFKTRAEVTFENGSVYNRVTLTGQTFKKDGHILRKNVAFQCPPSILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 501 - protein, 233 aa, Escherichia coli
MSSGTKLFEKEIPYVTELEGDVNGMKFTIHGKGTGDATVGTIKAKYICTTGDVPVPWATLVSTLSYGVQCFAKYPPHLKDFYKSAMPEGYVQERTITFEGDGVFKTRAEVTFENGSVYNRVTLTGQGFKKDGHILRKNVAFQCPPDILYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 502 - protein, 233 aa, Escherichia coli
MSSGTKLFTKEIPYVTELEGDVNGMKFTIHGKGTGDASTGTVKAKYICTTGDLPVPWATLVSTLSYGVQCFAKYPPHIKDFYKSCMPEGYVQERTITFEGDGVFKTRAEVTFENGSVYNRVKLNGETFKKDGHILRKNVAFQCPPDMVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 503 - protein, 233 aa, Escherichia coli
MSSGTKLFEKKIPYVTELEGDVNGMKFTIHGKGTGDATVGTIKAQFICTTGDLPVPWATLVSTLSYGVQCFAKYPPHLKDFYKSCMPEGYVQERTITFEGDGVFKTRAEVTFENGSVYNRVTLTGQGFKKDGHILRKNVAFQCPPDMVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 504 - protein, 233 aa, Escherichia coli
MSSGTLLFEKKIPYITELEGDVNGMKFTIHGKGTGDATVGKVDAKFICTTGDVPVPWATLVSTLSYGVQCFAKYPPELKDFFKSCMPEGYVQERTITFEGDGVFKTRAEVTFENGSVYNRVKLNGQGFKKDGHILRKNVAFQCPPSIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 505 - protein, 236 aa, Escherichia coli
MTALTEGALLFENEIPYITELEGDVNGMKFTIHGKGTGDASVGKVDAQFICTTGDVPVPWATLVSTLSYGVQCFAKYPPHIKDFFKSCMPEGYVQERTITFEGDGVFKTRAEVTFENGSVYNRVKLNGEGFKKDGHILRKNVAFQCPPSIVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 506 - protein, 236 aa, Escherichia coli
MTALTEGTKLFEKEIPYITELEGDVNGMKFTIHGKGTGDATTGTIKAKYICTTGDLPVPWATLVSTLSYGVQCFAKYPSHIKDFFKSAMPEGYVQERTITFEGDGVFKTRAEVTFENGSVYNRVKLNGQGFKKDGHILRKNVAFQCPPSMVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 507 - protein, 237 aa, Escherichia coli
MTALTEGAKLFEKEIPYITELEGDVEGMKFIIKGEGTGDATTGTIKAKYICTTGDVPVPWSTLVTTLTYGAQCFAKYGPELKDFYKSCMPEGYVQERTITFEGDGVFKTRAEVTFENGSVYNRVKLNGQGFKKDGHVLGKNLEFNFTPHCLCIWGDQANHGLKSAFKIMHEITGSKEDFIVADHTQMNTPIGGGPVHVPEYHHLTVWTKFGKDPDDDETDHLNIVEVIKAVDLETYR

SEQ ID NO: 508 - protein, 237 aa, Escherichia coli
MTALTEGAKLFEKEIPYITELEGDVEGMKFIIKGEGTGDATTGTIKAKYICTTGDVPVPWSTLVTTLTYGAQCFAKYGPELKDFYKSCMPEGYVQERTITFEGDGVFKTRAEVTFENGSVYNRVKLNGQGFKKDGHVLGKNLEFNFTPHCLCIWGDQANHGLKSAFKIMHEITGSKEDFIVADHTQMNTPIGGGPVHVPEYHHLTVWTSFGKDPDDDETDHLNIKEVIKAVDLETYR

SEQ ID NO: 509 - protein, 237 aa, Escherichia coli
MTALTEGAKLFEKEIPYITELEGDVEGMKFIIKGEGTGDATTGTIKAKYICTTGDVPVPWSTLVTTLTYGAQCFAKYGPELKDFYKSCMPEGYVQERTITFEGDGVFKTRAEVTFENGSVYNRVKLNGQGFKKDGHVLGKNLEFNFTPHCLCIWGDQANHGLKSAFKIMHEITGSKEDFIVADHTQMNTPIGGGPVHVPEYHHLTVWTSFGKDPDDDETDHLNIVERIKAVDLETYR

SEQ ID NO: 510 - protein, 237 aa, Escherichia coli
MTALTEGAKLFEKEIPYITELEGDVEGMKFIIKGEGTGDATTGTIKAKYICTTGDVPVPWSTLVTTLTYGAQCFAKYGPELKDFYKSCMPEGYVQERTITFEGDGVFKTRAEVTFENGSVYNRVKLNGQGFKKDGHVLGKNLEFNFTPHCLCIWGDQANHGLKSAFKIMHEITGSKEDFIVADHTQMNTPIGGGPVHVPEYHHLTVWTKFGKDPDDDETDHLNIKERIKAVDLETYR

SEQ ID NO: 511 - DNA, 54 bp, Tomato aspermy virus
gagggcaggggaagtctgctaacatgcggggacgtggaggaaaatcccggcccc

SEQ ID NO: 512 - DNA, 711 bp, Escherichia coli
atgacggcactgactgaaggcgcaaaactgttcgagaaagaaatcccatatatcactgagctggaaggtgacgttgaaggtatgaagtttatcatcaagggtgaaggtaccggtgacgcgagcgtcggtaaagtggatgctcagttcatttgtaccacgggcgacgttccggttccgtggagcacgctggtcaccacgctgacgtatggtgctcagtgctttgccaagtatccgcgccacattgcggatttcttcaaaagctgcatgccggaaggttacgtccaagagcgcaccatcacctttgagggtgatggcgtgttcaagacccgtgcggaagtcacctttgaaaatggcagcgtgtacaaccgtgtaaaactgaacggccagggtttcaagaaggacggccacgtgctgggcaaaaatctggagtttaactttacccctcattgtttgtacatttggggtgaccaagcgaatcatggcctgaagagcgcgttcaaaatcatgcatgagatcaccggctccaaagaggatttcattgttgccgatcacacccaaatgaataccccgattggtggtggtccggtgcacgtgccggagtaccaccacattacgtatcatgttaccctgtctaaagacgtcaccgatcaccgtgaccatttgaacattgttgaggtgatcaaggcagttgacctggagacgtaccgttaa

SEQ ID NO: 513 - DNA, 681 bp, Escherichia coli
atgtccctgtcgaaacaagtactgccacacgatgttaagatgcgctatcatatggatggctgcgttaatggtcattctttcaccattgagggtgaaggtgcaggcaaaccgtatgagggcaagaagatcttggaactgcgcgtgacgaaaggtggcccgctgccttttgcgttcgatatcctgagcagcgtttttacctacggtaaccgttgtttttgcgagtatccagaggacatgccggactactttaaacagagcctgccggaaggtcattcttgggaacgcaccctgatgtttgaggatggcggttgtggtacggcgagcgcgcacatttccctggacaagaactgcttcgtgcacaagagcaccttccacggcgtcaatttcccggcaaacggtccggtcatgcaaaagaaagctatgaactgggagccgagcagcgaactgattacggcgtgcgacggtatcctgaaaggcgatgtgaccatgtttctgttgctggaaggtggccaccgtcttaaatgtcagttcaccaccagctacaaagcccacaaggcagttaagatgccgccgaatcacattatcgaacacgtgcttgttaaaaaagaggttgccgacggctttcagatccaagagcatgcggtcgcaaagcacttcaccgtcgacgttaaagaaacgtga

SEQ ID NO: 514 - DNA, 714 bp, Escherichia coli
atgacggcattgacggaaggtaccaaactgtttgaaaaggaaatcccgtatatcactgaactggagggcgacgtcaatggtatgaagtttaccattcatggtaaaggtaccggcgatgcgaccacgggtaccattaaagcgaaatacatctgcactacgggcgacctgccggtcccgtgggcaaccctggtgagcaccctgagctacggtgttcagtgtttcgccaagtacccgagccacatcaaggatttctttaagagcgccatgccggaaggttatgttcaagagcgtaccatcaccttcgaaggcgacggcgtgtttaagacgcgtgctgaggttacctttgaaaacggttctgtctacaatcgtgtcaaactgaacggccagggttttaagaaagacggtcacattctgcgtaagaacgttgcattccaatgcccgccagatatggtgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacctgagcaaacacaccaaactgagcaaagaccgcgacgagcgccgtgatcacatgtgtctggtagaggtcgtgaaagcggttgatctggacacgtatcagtaatga

SEQ ID NO: 515 - DNA, 702 bp, Escherichia coli
atgtcgtctggtgccaaactgtttgaaaagaagatcccgtatatcactgaactggagggcgacgtcaatggtatgaagtttaccattcatggtaaaggtaccggcgatgcgagcacgggtaccgtgaaagcgcagttcatctgcactacgggcgacctgccggtcccgtgggcaaccctggtgagcaccctgagctacggtgttcagtgtttcgccaagtacccgagccacatcaaggatttctttaagagctgcatgccggaaggttatgttcaagagcgtaccatcaccttcgaaggcgacggcgtgtttaagacgcgtgctgaggttacctttgaaagcggttctgtctacaatcgtgtcacgctgactggccagggttttaagaaagacggtcacattctgcgtaagaacgttgcattccaatgcccgccagatattgtgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacctgagcaaacacaccaaactgagcaaagaccgcgacgagcgccgtgatcacatgtgtctggtagaggtcgtgaaagcggttgatctggacacgtatcagtga

SEQ ID NO: 516 - DNA, 714 bp, Escherichia coli
atgacggcattgacggaaggcgcaaaattgttcgaaaaagaaatcccatacatcaccgaactggaaggcgatgttgaaggtatgaagttcatcattaagggtgagggcaccggcgatgcaactacgggcaccattaaagcgaagtatatctgcaccaccggtgacgttccggtgccgtggagcacgctggtcaccaccctgacctatggcgcgcagtgtttcgcgaagtacggtccggaactgaaggacttctataagagctgtatgcctgagggctatgttcaggagcgtaccattacctttgagggtgatggtgtctttaagacgcgtgctgaggtgacctttgagaatggttccgtgtacaatcgcgtgaaactgaatggtcaaggttttaagaaagatggtcacgtgctgggcaaaaacctggagtttaactttactccgcattgcctgtgcatttggggcgaccaagcgaaccacggtctgaaaagcgcgttcaagattatgcacgagattacgggtagcaaagaggacttcatcgtggccgaccacacgcagatgaacaccccgatcggtggcggtccggtccatgtcccggagtaccaccacttgaccgtttggacctctttcggtaaagacccggatgatgacgaaacggatcatctgaatattgttgaggttatcaaagccgtcgacctggaaacttaccgttga

SEQ ID NO: 517 - DNA, 711 bp, Escherichia coli
atgacggcattgacggaaggtgcaaaactgtttgagaaagagatcccgtatatcaccgaactggaaggcgacgtcgaaggtatgaaatttatcattaaaggcgagggtaccggtgacgcgaccacgggtaccattaaagcgaaatacatctgcactacgggcgacctgccggtcccgtgggcaaccctggtgagcaccctgagctacggtgttcagtgtttcgccaagtacccgagccacatcaaggatttctttaagagcgccatgccggaaggttatacccaagagcgtaccatcagcttcgaaggcgacggcgtgtacaagacgcgtgctatggttacctacgaacgcggttctatctacaatcgtgtcacgctgactggtgagaactttaagaaagacggtcacattctgcgtaagaacgttgcattccaatgcccgccaagcattctgtatattctgcctgacaccgttaacaatggcatccgcgttgagttcaaccaggcgtacgatattgaaggtgtgaccgaaaaactggttaccaaatgcagccaaatgaatcgtccgttggcgggctccgcggcagtgcatatcccgcgttatcatcacattacctaccacaccaaactgagcaaagaccgcgacgagcgccgtgatcacatgtgtctggtagaggtcgtgaaagcggttgatctggacacgtatcagtga

SEQ ID NO: 518 - DNA, 711 bp, Escherichia coli; identical to SEQ ID NO: 512

SEQ ID NO: 519 - DNA, 702 bp, Homo sapiens
atgtccagcggagcgaaactgttcgagaagaagatcccctacatcaccgaactggagggcgacgtgaacgggatgaaattcaccatccacggtaaaggtactggcgacgcttcaactggaacggtgaaagcacagttcatctgcactactggtgacctaccggtcccctgggcaactctcgtatctacgctcagctacggcgtccagtgttttgccaaatacccctcccacatcaaagatttcttcaagtcttgcatgccagagggatatgtgcaagagcgtacaatcacattcgaaggcgatggtgtgtttaagactagggcggaggtaaccttcgagtcggggtccgtgtacaatagggtgacgctgaccggccagggcttcaagaaagatggacacatcttgcggaagaacgtggcattccagtgtccgccagacatcgtctacatcctgccagacaccgtgaataacggcatccgagtggaattcaaccaggcctacgacatcgagggtgtgaccgaaaaactggtcacgaagtgtagccagatgaaccgccctctcgcgggttcagcagcagtccatatcccgagatatcaccatctgagcaaacataccaaactgagcaaagatcgtgacgagcggagagatcacatgtgccttgtggaggtcgtgaaggccgtagacctcgatacctaccagtga

SEQ ID NO: 520 - DNA, 711 bp, Homo sapiens
atgacagctctgacagagggagcgaaactgttcgagaaggagatcccgtacatcacagagttggaaggagatgtcgaagggatgaaattcatcatcaagggagaaggaacgggtgacgcaacgaccggaacgatcaaggccaaatacatttgtaccacgggcgatttgcctgtcccctgggcgacgcttgtaagcacgctctcgtatggtgtccagtgcttcgcgaaatatccatcgcacattaaggactttttcaagtcggccatgccagaaggttacacacaagaacgaaccatctcctttgagggggacggagtgtataagacacgcgcgatggtaacgtacgagcgcgggtccatctacaacagggtaactcttactggggagaactttaagaaggacgggcatatcttgcggaaaaacgtggcatttcaatgtccgccctcgattctgtatattctcccggacacggtgaataatgggatcagagtggagttcaaccaggcatacgatattgagggtgtgactgaaaagctcgtcaccaaatgcagccagatgaatcgcccccttgcgggatcagcagccgtccatatcccccggtatcaccatattacctaccacacaaaactctcaaaagacagagatgagaggagggaccacatgtgcctggtcgaagtagtgaaggcggtggatcttgatacataccagtga

SEQ ID NO: 521 - DNA, 711 bp, Homo sapiens
atgactgccctgaccgaaggtgctaagctgtttgagaaggagattccgtacatcaccgagctggaaggagacgtcgaagggatgaagttcatcatcaagggagaaggaaccggagacgccacgactggaaccattaaggccaagtatatctgtaccactggagatctgccagtgccttgggccacccttgtgtcaaccctctcgtatggggtgcagtgttttgctaagtaccctagccacattaaggatttcttcaaatccgccatgccggaaggttatacccaagagcgcaccatttcttttgagggagacggagtgtacaagacccgcgccatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggcgggttcagcggctgtccacattccgcgctaccatcatatcacttatcacactaagctctccaaagaccgcgatgagaggagagatcacatgtgcctggtggaagtggtcaaggccgtcgatctcgatacctatcagtaa

SEQ ID NO: 522 - DNA, 711 bp, Homo sapiens
atgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaa

SEQ ID NO: 523 - DNA, 714 bp, Homo sapiens
atgacggccctgacagaaggtgcgaagctgttcgagaaggagattccctatatcacagaattggagggggatgtagagggtatgaagtttatcatcaaaggcgaagggacaggggatgcaacaactggaacaattaaggctaagtacatttgcacgaccggcgacgtcccggtgccctggtccacgctcgtcaccacgctcacgtacggagcccagtgctttgccaaatatggccctgaacttaaagacttctacaagtcgtgtatgccggagggatacgtgcaagagaggacgatcacctttgaaggtgacggagtattcaaaacaagagcggaggtgacgttcgagaatggatcggtctataaccgggtcaagctcaacggacagggctttaagaaagatggacacgtccttgggaagaatttggagttcaatttcaccccgcattgtctttacatctggggtgatcaggcgaatcacgggttgaaatcagcgttcaagatcatgcacgagattacggggagcaaagaggactttatcgtggcagaccacactcagatgaacactccaatcggagggggtcccgtacacgtacccgagtatcatcacctgaccgtctggacatcgtttggaaaagaccctgacgacgatgaaactgatcatctcaacattgtggaagtgatcaaggcggtggacttggaaacataccgctga

SEQ ID NO: 524 - DNA, 681 bp, Homo sapiens
atgtctctatccaaacaggtcctcccacgggacgtcaaaatgcgttaccacatggacggctgtgtcaatggtcatcagttcatcatcgaaggcgaaggtactggcaaaccgtacgaggggaagaaaatcttggagctaagagtgacgaagggcggtcctctgccctttgcattcgatatcctgtccagcgtgttcacttatggaaacaggtgcttttgtgagtaccccgaggacatgccggattacttcaaacagagcctgcccgagggacatagctgggaacgaacgctcatgttcgaggatggaggctgcggcaccgcgtctgctcacatctcactggacaaaaactgcttcgtgcacaagagcactttccacggtgtgaacttcccagcaaacggtccggtgatgcagaagaaagccatgaactgggagccctcgtccgaactgatcaccgcatgcgatggaatccttaagggggatgtaaccatgttcctgctgctggagggcggtcacagactcaagtgtcagttcactacctcatacaaagcccacaaagcggtgaagatgccaccgaatcacatcatcgagcatgtactcgtcaaaaaggaggtcgcggacggcttccaaatccaagagcatgcagtggcaaaacatttcacagtggacgtgaaagaaacctaa

SEQ ID NO: 525 - DNA, 681 bp, Homo sapiens
atgagtctctctaagcaagtgctgccacatgacgtcaagatgaggtaccacatggatggatgcgtgaacggtcactccttcactattgaaggtgaaggggctggaaagccgtacgaggggaagaagattctggagctgcgcgtcactaaaggaggacccctgccttttgcctttgacatccttagctcagtctttacgtatggaaatcgctgcttctgtgagtatcctgaggatatgcctgactactttaagcagagcctgcccgagggtcactcatgggaaagaactctgatgttcgaggatggagggtgtggaaccgcgagcgcgcacatcagcctcgacaagaattgctttgtgcataagtccaccttccacggagtgaacttcccggccaacggacccgtgatgcagaagaaagccatgaactgggagccatcttcggaacttatcaccgcctgcgacgggattctcaagggagatgtcaccatgttcctcctgctggaaggaggacatcggctcaagtgtcagttcaccacctcctataaggctcacaaggccgtgaagatgccgccaaatcatatcatcgagcatgtccttgtcaagaaggaggtggctgacggatttcagattcaagaacacgccgtggccaagcatttcaccgtggatgtgaaggaaacttaa

SEQ ID NO: 526 - DNA, 678 bp, Homo sapiens
tctctatccaaacaggtcctcccgcatgacgtcaaaatgaggtaccacatggacggctgcgtcaatggtcatagcttcactatcgaaggcgaaggtgccggcaaaccgtacgaggggaagaaaatcttggagctaagagtgacaaagggcggtcctctgccattcgcattcgacatcctgtccagcgtgttcacttatggaaaccgttgcttttgtgagtacccggaggacatgccggattactttaagcagagcctgcccgagggacattcgtgggaacgaacgctcatgttcgaggatggaggctgcggcaccgcgtctgctcacatcagcctggacaaaaactgcttcgtgcacaagagcactttccacggtgtgaacttccccgcaaacggtccagtgatgcagaagaaagccatgaactgggagccctcatccgaactgatcaccgcatgtgatggaatccttaagggggatgtaaccatgttcctgctgctggagggcggtcaccggctcaagtgtcagttcactacctcatacaaagcccacaaagcggtgaagatgccacccaatcacatcatcgagcatgtactcgtcaaaaaggaggtcgcggatggattccagatccaagagcacgcagtggcaaaacatttcacagtggacgtgaaagaaacctaa

SEQ ID NO: 527 - DNA, 675 bp, Saccharomyces cerevisiae
tccctgagtaaacaagtgttgccaagagatgtcaaaatgcggtatcacatggatggatgcgttaatggtcaccagtttatcatcgaaggtgaaggcactggaaaaccatacgaaggtaaaaagatattagaactaagagttaccaagggtggtcctttgccatttgcgtttgacattttgtcatctgttttcacttacggtaaccggtgtttttgtgaatacccagaagatatgcctgattatttcaagcaatcccttccagaggggcatagctgggaaaggacattaatgttcgaggatggtggttgcgggacagcctctgctcatatctctttagacaaaaattgttttgtgcataagtctacatttcatggcgttaatttccctgctaacggacctgttatgcagaaaaaggccatgaattgggagccaagttcagaactgatcacggcttgcgacggcattttgaaaggagatgttacaatgttccttttactcgaaggcggtcatcggttgaaatgtcaattcaccacttcatacaaagcccataaggcagtaaagatgcctccaaaccacattattgaacacgtactagtcaaaaaggaagtagcagatggctttcaaatacaagagcatgcagtcgctaaacattttacagtagacgtgaaagagact

SEQ ID NO: 528 - DNA, 708 bp, Saccharomyces cerevisiae
acagctttaactgaaggggccaagcttttcgaaaaagagatcccatatatcaccgaacttgaaggtgacgttgagggtatgaagtttatcataaaaggagaaggcacaggtgatgcgacaacgggtacaatcaaggcaaagtacatttgtacaactggggacttacctgtcccatgggccactttggtgtctactttgtcttacggcgtacaatgttttgctaagtacccttcacacatcaaagatttctttaagtctgcaatgcctgaaggatacacacaggaacgtacaatttcatttgagggcgacggtgtctataaaacaagagctatggttacttatgaaagaggttccatctacaacagagtgacactaacgggcgaaaatttcaaaaaggatggacatattttgcgtaaaaacgtagctttccaatgcccaccatcaatactatacattctgccagatactgtaaacaatggtattagagtcgagtttaatcaagcttatgatatagaaggtgtcactgaaaaattggttacaaaatgcagccaaatgaatagaccattggcaggatctgccgctgtgcatatccctagataccatcacattacctaccacaccaaattaagtaaagacagggatgaacgaagagatcatatgtgtttagttgaggttgttaaggcagttgatctcgacacttaccaatga

SEQ ID NO: 529 - DNA, 711 bp, Pichia pastoris
atgaccgcactaacagaaggagctaaactattcgaaaaggagattccttacattacagaattagagggtgatgtcgaaggaatgaaattcattatcaagggcgagggtactggtgacgctactaccggtacgattaaagcaaagtacatctgtacaacaggtgaccttcctgttccgtgggctactctggtgagcactttgtcttatggagttcaatgttttgctaaatacccttcgcacattaaagactttttcaaaagtgcaatgcctgagggctatactcaggagagaacaatatctttcgaaggagatggtgtgtataagactagggctatggtcacgtatgaaagaggatccatctacaatagagtaactttaactggtgaaaacttcaaaaaggacggtcacatccttagaaagaatgttgcctttcaatgcccaccatccatcttgtacattttgccagacacagttaacaatggtatcagagttgagtttaaccaagcttatgacatagagggtgtcaccgaaaagttggttacaaaatgttcacagatgaatcgtcccctggcaggatcagctgccgtccatatcccacgttaccatcatatcacttatcataccaagctgtccaaagatcgtgatgagagaagggatcacatgtgtttggttgaagtggtaaaggccgtggatttggatacttaccaataa

SEQ ID NO: 530 - DNA, 711 bp, Pichia pastoris
atgactgcattaacagaaggagctaagttgttcgaaaaagagataccttatatcacagaattggaaggtgacgtagaaggtatgaaattcatcattaagggtgaaggaacaggagatgctaccacaggaacaatcaaagcaaaatacatttgtactactggtgacttgcccgttccttgggccacactagtctccacactctcatacggtgttcaatgttttgcaaagtacccgtcgcatatcaaagactttttcaagtctgctatgccagaaggatatacgcaagagagaactatctcctttgagggtgatggcgtgtacaaaactcgtgccatggttacttacgagagaggtagcatctacaatcgtgtcaccttgaccggtgagaacttcaaaaaggatggtcatattctgcgtaaaaacgtcgcatttcagtgtccaccttccattctgtatatcctgccagacaccgtgaataatggcataagagtagagttcaaccaagcttatgacatcgaaggagttactgagaagcttgttactaagtgtagtcagatgaatagaccattagccggttcagctgctgtccatattcctagatatcaccacattacttaccacacgaaattgtctaaggatagagatgagaggagggatcatatgtgccttgtggaagtggttaaggctgttgatttggacacttatcaatga

SEQ ID NO: 531 - DNA, 690 bp, Escherichia coli
atggcgagcttggttaagaaagatatgtgtattaagatgacgatggaaggtactgtgaacggttatcactttaagtgcgttggcgagggtgaaggcaagccgttcgagggcacgcagaacatgcgcactcgtgtcaccgagggcggtccgctgccttttgcattcgacatcctggccccgtgctgtatgtacggctctaagaccttcattaaacacgtgagcggtatcccggattactttaaagagtcctttccagagggcttcacttgggaacgtacccagatttttgaggacggtggtgttctgaccgcgcaccaagacaccagcctggaaggtaattgcctgatctataaagtgaaggttctgggtaccaatttcccggcgaatggtccggtgatgcaaaagaaaaccgcgggttgggagccgtgcgtcgagatgctgtatccgcgtgacggcgtcttgtgtggtcagagcttgatggcgctgaagtgcaccgatggcaatcatctgaccagccacctccgcacgacgtatcgtagccgtaaaccgagcaacgccgttaacatgccggagttccattttggtgaccatcgcatcgaaatcctgaaagctgagcagggcaaattctacgaacaatacgaatcggctgtcgcacgttacagcgatgtgccggaaaaagcgacgtaatga

SEQ ID NO: 532 - DNA, 699 bp, Escherichia coli
atggcgagcaaaatcagccataacgtacgtatcaaattgtatatggaaggcacggtaaatggccactactttaagtgcacgggcaagggtgaaggtaatccgttcgagggtacccaagagatgaaaattgaagtcatcgagggtggtccgctgccatttagcttcgacattctgaccccgaactgccagtatggtagcgttgcaattactaagtacacctcgggcatccctgattactttaagcagagctttccggaaggtttcacctgggagcgtacgaccatttacgaagatggtggcgtcctgaccgcgcatcaagatacgagcctggaaggtaattgtctggtgtacaacatcaaaattctgggctgtaacttcccgccgaacggcccagtgatgcaaaagaaaacccaaggctgggagccgtgctgcgaaatgcgttatacgcgcgacggtgttctgtgcggccagaccctgatggctctgaaatgcgcggacggtaatcatctgacgtgtcacctgcgcactacctaccgctctaagaaagcagccaaggcgttgcagatgccgccgtttcacttctccgaccatcgtccggagatcgttaaagtgagcgagaatggtaccctgttcgagcagcacgagagcagcgtcgcccgttattgtcagacctgtccgtccaagttgggtcacaactaa

SEQ ID NO: 533 - DNA, 696 bp, Escherichia coli
atggcaagcttggttaagaaagatatgtgtattaagatgacgatggagggtactgtgaacggtcaccatttcaaatgcgtcggtgagggtgaaggcaaaccgttcgaaggtacccaggttgaaaagatccgcatcaccgaaggtggcccgctgccgtttgcgtacgacatcctggcaccgtgctgcatgtacggcagcaagacgttcattaagcacgtatcgggcattcctgattacttcaaagaaagctttccggagggctttacgtgggagcgtacccagatttttgaggacggtggttatttgaccattcaccaagatacctccctgcagggcaataactttatcttcaaagttaatgttatcggcgcgaatttcccggcgaatggcccagtgatgcaaaagaaaacggcgggttgggagccgtgcgtggagatgctgtacccgcgtgatggtgtcctgtgtggtcagagcctgatggccctgaaatgtaccgacggtaaccacctgaccagccatctgcgtactacctaccgcagccgtaagccgagcaacgccgtcaacatgccggagtttcacttcggcgaccatcgcatcgaaattctgaaagctgagcaaggtaaattctatgaacaatatgagagcgcggtggcacgttattgcgaagcggctccgtctaagctgggtcatcactaa

SEQ ID NO: 534 - DNA, 696 bp, Escherichia coli
atggcaagcttggttaagaaagatatgtgtattaagatgacgatggagggtactgtgaacggtcaccatttcaaatgcgtcggtgagggtgaaggcaaaccgttcgaaggtacccagaacatgcgtatccgcgtaaccgaaggtgcgccgctgccgtttgcgttcgacatcctgagcccgtgctgcgcgtacggcagcaagacgttcattaagcacgtatcgggcattcctgattacttcaaagaaagctttccggagggctttacgtgggagcgtaccaccatttatgaggacggtggtgttctgaccgcgcaccaagatacctccctggaaggcaattgtctgatctacaaagttaaggttctgggcactaatttcccggcggatggcccagtgatgaagaaaatctccggtggttgggagccgtgcgtggagatgctgtacccgcgtgatggtgtcctgtgtggtcagagcctgatggccctgaaatgtaccgacggtaaccacctgaccagccatctgcgtactacctaccgcagccgtaagccgagcaacgccgtcaacatgccggagtttcacttcggcgaccatcgcatcgaaattctgaaagctgagcaaggtaaattctatgaacaatatgagagcgcggtggcacgttattgcgaagcggctccgtctaagctgggtcatcactaa

SEQ ID NO: 535 - DNA, 687 bp, Escherichia coli
atggcgagcttggttaagaaagatatgtgtattaagatgacgatggaaggtactgtgaacggttatcactttaagtgcgttggcgagggtgaaggcaagccgttcgagggcacgcagaacatgcgcattcgtgtcaccgagggcggtccgctgccttttgcattcgacatcctggccccgtgctgtatgtacggctctaagaccttcattaaacacgtgagcggtatcccggattactttaaagagtcctttccagagggcttcacttgggaacgtacccagatttttgaggacggtggtgttctgaccgcgcaccaagacaccagcctggaaggtaattgcctgatctataaagtgaaggttctgggtaccaatttcccggcgaatggtccggtgatgcaaaagaaaaccgcgggttgggagccgtgcgtcgagatgctgtatccgcgtgacggcgtcttgtgtggtcagagcttgatggcgctgaagtgcaccgatggcaatcatctgaccagccacctgcgcacgacgtatcgtagccgtaaaccgagcaacgccgttaacatgccggagttccattttggtgaccatcgcatcgaaatcctgaaagctgagcagggcaaattctacgaacaatacgaatcggctgtcgcacgttacagcgatgtgccggaaaaagcgacgtaa

SEQ ID NO: 536 - DNA, 687 bp, Escherichia coli
atggcgagcttggtaaagaaagatatgtgcattaagatgactatggagggtactgtgaatggctaccacttcaagtgtgaaggtgaaggtgatggtaatccgttcgaaggtacgcaaaacatgcgcatccgtgtcaccgagggtgcgccgctgccgttcgcttacgacattctggcgccgtgctgtatgtacggttctaaaacctttatcaagcacacctcgggtatcccggactatttcaaagagagcttcccagagggtttcacctgggaacgtaccaccatttatgaggatggcggctacctgaccatccatcaagacacgagcctggaaggcaactgcctgatctacaaggttaaggtgctgggtacgaactttcctgcaaatggcccggtgatgcagaaaaagaccgccggttgggagccgtgcgtcgagatgctgtatccgcgtgacggcgtgctgtgtggccagagcctgatggcgttgaaatgcaccgacggcaaccatctgacgagccacttgcgcacgacctatcgctcccgtaaaccgagcaacgcggtcaatatgccggaatttcattttggtgatcaccgtattgagattctgaaagcagagcaaggtaagttttatgaacagtacgagagcgccgttgcgcgttacagcgatgttccggaaaaagctacgtaa

SEQ ID NO: 537 - DNA, 696 bp, Escherichia coli
atgagcaaaatcagcgacaacgtccgcatcaaattgtacatggaaggcacggtaaataaccaccactttatgtgtgaggctgaaggcgagggtaaaccgtacgagggtacccaggaaatgaagattgaggtgattgaaggtggcccgctgccgttcgcattccatattctgagcaccagctgtatgtacggctctaaaacgttcatcaaatatgtcagcggtatccctgactatttcaagcagtccttcccggaaggtttcacctgggagcgtacgactacctacgaggatggcggttttctgacggcgcatcaagacaccagcttggacggcgattgcctggtttacaaggttaagatcctgggtaataactttccggcggatggtccggttatgcagaataaagcagagcgctgggaaccggccaccgagattctgtatgaggtggatggtgtgctgcgtggccaaaccctgatggcgttgaagtgcgcggacggtaaccatctgacctgccacctgcgtaccacgtatcgtagcaagaaaccggcgtcggccctgaagatgccaggttttcactttggtgatcaccgcatcgagattatggaagaagttgagaaaggcaagtgttacaagcaatatgaagccgcggtcgcacgttactgcgacgcggctccgagcaaactgggtcaccattaa

SEQ ID NO: 538 - DNA, 687 bp, Escherichia coli
atggcgagcttggttaagaaagatatgtgtattaagatgacgatggaaggtactgtgaacggttatcactttaagtgcgttggcgagggtgaaggcaagccgttcgagggcacgcagaacacgcgcattcgtgtcaccgagggcggtccgctgccttttgcattcgacatcctggccccgtgctgtatgtacggctctaagaccttcattaaacacgtgagcggtatcccggattactttaaagagtcctttccagagggcttcacttgggaacgtacccagatttttgaggacggtggtgttctgaccgcgcaccaagacaccagcctggaaggtaattgcctgatctataaagtgaaggttctgggtaccaatttcccggcgaatggtccggtgatgcaaaagaaaaccgcgggttgggagccgtgcgtcgagatgctgtatccgcgtgacggcgtcttgtgtggtcagagcttgatggcgctgaagtgcaccgatggcaatcatctgaccagccacctgcgcacgacgtatcgtagccgtaaaccgagcaacgccgttaacatgccggagttccattttggtgaccatcgcatcgaaatcctgaaagctgagcggggcaaattctacgaacaatacgaatcggctgtcgcacgttacagcgatgtgccggaaaaagcgacgtaa

SEQ ID NO: 539 - DNA, 687 bp, Escherichia coli
atggcgagcttggttaagaaagatatgtgtattaagatgacgatggaaggtactgtgaacggttatcactttaagtgcgttggcgagggtgaaggcaagccgttcgagggcacgcagaacatgcgcactcgtgtcaccgagggcggtccgctgccttttgcattcgacatcctggccccgtgctgtatgtacggctctaagaccttcattaaacacgtgagcggtatcccggattactttaaagagtcctttccagagggcttcacttgggaacgtacccagatttttgaggacggtggtgttctgaccgcgcaccaagacaccagcctggaaggtaattgcctgatctataaagtgaaggttctgggtaccaatttcccggcgaatggtccggtgatgcaaaagaaaaccgcgggttgggagccgtgcgtcgagatgctgtatccgcgtgacggcgtcttgtgtggtcagagcttgatggcgctgaagtgcaccgatggcaatcatctgaccagccacctgcgcacgacgtatcgtagccgtaaaccgagcaacgccgttaacatgccggagttccattttggtgaccatcgcatcgaaatcctgaaagctgagcagggcaaattctacgaacaatacgaatcggctgtcgcacgttacagcgatgtgccggaaaaagcgacgtaa

SEQ ID NO: 540 - DNA, 687 bp, Saccharomyces cerevisiae
atggcgtcccttgttaaaaaggacatgtgtattaagatgactatggagggtaccgtcaacggttaccactttaagtgcgtcggtgaaggtgaaggtaaaccatttgaaggcactcaaaacatgaggataagagtcactgaaggtgggccactacctttcgcattcgatatcttggctccttgctgcatgtacggctccaaaacgttcatcaaacatgtgtcaggcattccagactactttaaggagtcatttccagaagggttcacatgggagagaacacagatatttgaggatggaggagttttgactgctcaccaagatacctctttggagggaaattgtcttatctacaaggttaaagttttaggtacaaatttccctgccaatggtccagtaatgcagaagaaaacagctggctgggaaccatgtgttgaaatgctatatcctagagatggagtattatgtggacaatctttgatggcactgaaatgtacagacggtaatcatctcacaagtcatctgagaactacttacagaagcagaaaaccatctaatgccgtgaacatgcctgaatttcactttggcgatcatagaattgaaatcttaaaagccgaacaagggaagttttacgaacaatatgaatctgctgtagctcgttattcagatgtgccagaaaaagcaacataa

SEQ ID NO: 541 - DNA, 696 bp, Pichia pastoris
atggccagcttagtgaaaaaggatatgtgcatcaaaatgacgatggaaggaactgtgaacggtcatcactttaagtgtgtcggtgaaggtgagggtaagcctttcgagggtacacagaatatgagaattagagtaactgaaggcgctcctttgccttttgcttttgatatcctgtccccatgttgcgcatatggaagtaagacgttcattaaacatgtttccggaataccagactacttcaaggagagctttccagaaggttttacttgggagcgtaccacaatttacgaagatggaggtgtccttactgcacatcaagacacttcactcgagggtaattgtttgatctacaaggttaaagtcctgggcactaacttccccgctgacggtccagttatgaaaaagatttctggtggttgggagccttgtgtggaaatgctatatcctagagacggtgttttgtgtggacaatctttgatggctttgaaatgtacagatggtaatcatttgacatcacaccttagaacaacctatcgtagtaggaaaccatctaatgccgttaacatgccagaatttcatttcggtgatcacagaatcgagatcttaaaagctgaacagggaaaattctacgaacaatacgagtccgcagtagctcgatattgcgaggctgcaccctcgaagctaggacaccattag

SEQ ID NO: 542 - DNA, 687 bp, Pichia pastoris
atggcttcacttgtgaaaaaggatatgtgtattaagatgactatggagggtactgtaaacggttaccacttcaaatgtgtaggtgaaggagagggaaaaccatttgaaggtactcaaaacatgagaatccgtgtcacagagggcggtcctttaccatttgctttcgacattttggctccatgttgcatgtatggttctaagacttttatcaaacatgtttctggtattcccgactacttcaaagagagcttcccagaaggatttacctgggagaggacacagatattcgaagatggaggtgtcctgacagcccatcaagatacgtccttagaaggaaattgcttgatctacaaagttaaggtgctgggcaccaattttcctgccaatggtcccgttatgcaaaagaaaactgctggttgggaaccttgtgttgagatgctatatccaagagatggtgttttgtgtggacagtcacttatggctctgaagtgtacagatggtaaccatttgacttcccacttgcgtaccacttatagaagtagaaaaccttcgaatgcagtgaatatgccagagttccattttggtgaccacagaattgagatcctcaaggcagaacaaggaaaattctatgaacaatacgaaagcgcagtggctaggtactccgacgttcctgagaaggcaacataa

SEQ ID NO: 543 - DNA, 687 bp, Pichia pastoris
atggcaagtttagtgaaaaaggacatgtgtatcaaaatgactatggaaggtactgtaaatggatatcatttcaagtgcgttggagagggtgagggtaagccatttgaaggtacacagaacaccagaatacgtgtaactgagggtggaccattgccttttgccttcgatatccttgcaccttgttgcatgtacggctcgaaaaccttcatcaagcacgtctccggcattcctgactatttcaaggaatcattccctgaaggttttacgtgggagagaactcaaatctttgaggatggtggagttctgactgcacatcaagatacatccttagaaggaaattgtttgatttacaaagttaaagtgctaggaacaaacttcccagctaatggtcccgttatgcagaaaaagactgctggctgggagccttgtgtcgaaatgctgtacccccgagacggtgtcttgtgtggtcaatctttgatggctttgaaatgtacagatggtaatcacctgacaagtcatcttagaacaacttaccgttccagaaagccatctaatgcagtgaacatgccagaatttcactttggtgaccataggattgagattctcaaggccgaaagaggtaaattctatgagcaatacgagtcagctgttgctaggtatagcgatgttccagaaaaagctacttaa

SEQ ID NO: 544 - DNA, 687 bp, Pichia pastoris
atggctagcttagtgaaaaaggatatgtgtattaagatgactatggagggcacagttaatggttaccacttcaaatgtgaaggtgagggagacggtaaccctttcgagggcactcagaacatgcgtatcagggttactgaaggtgctcccttgccatttgcatacgacatcttggcaccttgctgcatgtacggatcaaaaactttcattaaacacacgagtggtatacctgattactttaaggaatctttccccgagggatttacttgggagagaacaactatttacgaggacggtggatatctgacaatccatcaagatacatccttagaaggtaattgtctcatttacaaggtaaaagtattgggaacgaatttcccagcaaatggtccggttatgcaaaagaaaaccgctggttgggagccatgtgtcgaaatgctgtatccaagggatggagtcctttgtggtcagtcccttatggctctgaaatgtactgatggtaatcatctaacaagccatttgagaacaacctatcgttcgagaaaaccatccaacgctgtgaacatgcctgagtttcattttggtgaccacagaatcgaaatcttgaaggcagaacaaggaaagttctatgagcaatacgaatctgccgttgctagatattcagacgtgccagaaaaggccacctaa

SEQ ID NO: 545 - DNA, 696 bp, Pichia pastoris
atgtccaaaatctcagacaacgttcgtatcaaactatacatggagggtaccgtcaataatcatcactttatgtgtgaagctgaaggagagggaaaaccatacgagggtacacaggagatgaagattgaagttatagaaggtggtcctctgccattcgcttttcacattttgtcaacttcctgcatgtatggaagcaagacctttatcaaatatgtgtccggtatccctgactacttcaagcaatcgttcccagaaggatttacttgggagagaactacaacttatgaggatggaggctttctgacagcacatcaggacacatctttagatggtgactgtttggtctacaaagtaaagattttgggtaacaatttccctgcagatggtccagtgatgcaaaacaaggccgagaggtgggagcccgctactgaaatcttgtatgaagttgatggtgtgcttagaggtcaaacactaatggctcttaaatgtgctgatggaaatcatttgacctgtcatctcagaacgacttacagaagtaaaaagccagccagcgcattgaagatgcccggattccatttcggtgaccaccgtattgaaatcatggaagaggtagaaaaaggcaagtgttacaagcaatatgaggctgccgttgcaagatactgcgatgcagctccttctaaactgggtcatcactaa

SEQ ID NO: 546 - protein, 233 aa, Escherichia coli
  misc_feature (5)..(6): Xaa can be any naturally occurring amino acid
  misc_feature (9)..(11): Xaa can be any naturally occurring amino acid
  misc_feature (15)..(15): Xaa can be any naturally occurring amino acid
  misc_feature (38)..(39): Xaa can be any naturally occurring amino acid
  misc_feature (41)..(46): Xaa can be any naturally occurring amino acid
  misc_feature (52)..(53): Xaa can be any naturally occurring amino acid
  misc_feature (59)..(59): Xaa can be any naturally occurring amino acid
  misc_feature (75)..(78): Xaa can be any naturally occurring amino acid
  misc_feature (82)..(82): Xaa can be any naturally occurring amino acid
  misc_feature (85)..(85): Xaa can be any naturally occurring amino acid
  misc_feature (97)..(97): Xaa can be any naturally occurring amino acid
  misc_feature (105)..(105): Xaa can be any naturally occurring amino acid
  misc_feature (114)..(114): Xaa can be any naturally occurring amino acid
  misc_feature (122)..(122): Xaa can be any naturally occurring amino acid
  misc_feature (124)..(124): Xaa can be any naturally occurring amino acid
  misc_feature (126)..(127): Xaa can be any naturally occurring amino acid
  misc_feature (142)..(142): Xaa can be any naturally occurring amino acid
  misc_feature (144)..(144): Xaa can be any naturally occurring amino acid
  misc_feature (146)..(148): Xaa can be any naturally occurring amino acid
  misc_feature (150)..(150): Xaa can be any naturally occurring amino acid
  misc_feature (183)..(183): Xaa can be any naturally occurring amino acid
  misc_feature (193)..(193): Xaa can be any naturally occurring amino acid
  misc_feature (212)..(212): Xaa can be any naturally occurring amino acid
MSSGXXLFXXXIPYXTELEGDVNGMKFTIHGKGTGDAXXGXXXXXXICTTGXXPVPWAXLVSTLSYGVQCFAKYXXXXKDFXKSXMPEGYVQERTIXFEGDGVFXTRAEVTFEXGSVYNRVXLXGXXFKKDGHILRKNVAFXCXPXXXYXLPDTVNNGIRVEFNQAYDIEGVTEKLVTKCSQXNRPLAGSAAXHIPRYHHLSKHTKLSKDRXERRDHMCLVEVVKAVDLDTYQ

SEQ ID NO: 547 - protein, 226 aa, Escherichia coli
  misc_feature (10)..(10): Xaa can be any naturally occurring amino acid
  misc_feature (13)..(14): Xaa can be any naturally occurring amino acid
  misc_feature (16)..(16): Xaa can be any naturally occurring amino acid
  misc_feature (25)..(26): Xaa can be any naturally occurring amino acid
  misc_feature (28)..(28): Xaa can be any naturally occurring amino acid
  misc_feature (34)..(34): Xaa can be any naturally occurring amino acid
  misc_feature (36)..(36): Xaa can be any naturally occurring amino acid
  misc_feature (38)..(38): Xaa can be any naturally occurring amino acid
  misc_feature (43)..(45): Xaa can be any naturally occurring amino acid
  misc_feature (47)..(47): Xaa can be any naturally occurring amino acid
  misc_feature (49)..(49): Xaa can be any naturally occurring amino acid
  misc_feature (60)..(60): Xaa can be any naturally occurring amino acid
  misc_feature (63)..(64): Xaa can be any naturally occurring amino acid
  misc_feature (66)..(66): Xaa can be any naturally occurring amino acid
  misc_feature (74)..(74): Xaa can be any naturally occurring amino acid
  misc_feature (78)..(78): Xaa can be any naturally occurring amino acid
  misc_feature (91)..(92): Xaa can be any naturally occurring amino acid
  misc_feature (97)..(97): Xaa can be any naturally occurring amino acid
  misc_feature (99)..(99): Xaa can be any naturally occurring amino acid
  misc_feature (103)..(103): Xaa can be any naturally occurring amino acid
  misc_feature (105)..(105): Xaa can be any naturally occurring amino acid
  misc_feature (107)..(107): Xaa can be any naturally occurring amino acid
  misc_feature (112)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (119)..(119): Xaa can be any naturally occurring amino acid
  misc_feature (121)..(121): Xaa can be any naturally occurring amino acid
  misc_feature (125)..(125): Xaa can be any naturally occurring amino acid
  misc_feature (132)..(132): Xaa can be any naturally occurring amino acid
  misc_feature (137)..(137): Xaa can be any naturally occurring amino acid
  misc_feature (140)..(141): Xaa can be any naturally occurring amino acid
  misc_feature (144)..(144): Xaa can be any naturally occurring amino acid
  misc_feature (152)..(153): Xaa can be any naturally occurring amino acid
  misc_feature (166)..(167): Xaa can be any naturally occurring amino acid
  misc_feature (172)..(173): Xaa can be any naturally occurring amino acid
  misc_feature (179)..(179): Xaa can be any naturally occurring amino acid
  misc_feature (184)..(184): Xaa can be any naturally occurring amino acid
  misc_feature (189)..(189): Xaa can be any naturally occurring amino acid
  misc_feature (198)..(198): Xaa can be any naturally occurring amino acid
  misc_feature (201)..(202): Xaa can be any naturally occurring amino acid
  misc_feature (204)..(205): Xaa can be any naturally occurring amino acid
  misc_feature (207)..(208): Xaa can be any naturally occurring amino acid
  misc_feature (211)..(211): Xaa can be any naturally occurring amino acid
  misc_feature (217)..(218): Xaa can be any naturally occurring amino acid
  misc_feature (220)..(220): Xaa can be any naturally occurring amino acid
  misc_feature (222)..(226): Xaa can be any naturally occurring amino acid
MSLSKQVLPXDVXXRXHMDGCVNGXXFXIEGEGXGXPXEGKKXXXLXVXKGGPLPFAFDXLSXXFXYGNRCFCXYPEXMPDYFKQSLPEGXXWERTXMXEDGXCXTXSAHIXLXKXCFXHXSTFXGVNFPAXGPVMXKKXXNWXPSSELITXXDGILKGDVTMFLXXEGGHXXKCQFTXSYKAXKAVKXPPNHIIEHXLVXXEXXDXXQIXEHAVAXXFXVXXXXX

SEQ ID NO: 548 - protein, 236 aa, Escherichia coli
  misc_feature (24)..(24): Xaa can be any naturally occurring amino acid
  misc_feature (45)..(45): Xaa can be any naturally occurring amino acid
  misc_feature (67)..(68): Xaa can be any naturally occurring amino acid
  misc_feature (74)..(74): Xaa can be any naturally occurring amino acid
  misc_feature (84)..(85): Xaa can be any naturally occurring amino acid
  misc_feature (149)..(149): Xaa can be any naturally occurring amino acid
  misc_feature (165)..(165): Xaa can be any naturally occurring amino acid
  misc_feature (167)..(168): Xaa can be any naturally occurring amino acid
  misc_feature (227)..(227): Xaa can be any naturally occurring amino acid
MTALTEGAKLFEKEIPYITELEGXVEGMKFIIKGEGTGDASVGKXDAQFICTTGDVPVPWSTLVTTXXYGAQCXAKYPRHIADXXKSCMPEGYVQERTITFEGDGVFKTRAEVTFENGSVYNRVKLNGQGFKKDGHVLGKNLEFNFTPXCLYIWGDQANHGLKSXFXXMHEITGSKEDFIVADHTQMNTPIGGGPVHVPEYHHITYHVTLSKDVTDHRDHLNIVEVXKAVDLETYR

SEQ ID NO: 549 - protein, 231 aa, Escherichia coli
  misc_feature (11)..(11): Xaa can be any naturally occurring amino acid
  misc_feature (22)..(22): Xaa can be any naturally occurring amino acid
  misc_feature (27)..(27): Xaa can be any naturally occurring amino acid
  misc_feature (31)..(31): Xaa can be any naturally occurring amino acid
  misc_feature (33)..(33): Xaa can be any naturally occurring amino acid
  misc_feature (40)..(43): Xaa can be any naturally occurring amino acid
  misc_feature (45)..(45): Xaa can be any naturally occurring amino acid
  misc_feature (49)..(49): Xaa can be any naturally occurring amino acid
  misc_feature (55)..(55): Xaa can be any naturally occurring amino acid
  misc_feature (59)..(59): Xaa can be any naturally occurring amino acid
  misc_feature (63)..(63): Xaa can be any naturally occurring amino acid
  misc_feature (73)..(73): Xaa can be any naturally occurring amino acid
  misc_feature (82)..(82): Xaa can be any naturally occurring amino acid
  misc_feature (94)..(94): Xaa can be any naturally occurring amino acid
  misc_feature (96)..(96): Xaa can be any naturally occurring amino acid
  misc_feature (101)..(101): Xaa can be any naturally occurring amino acid
  misc_feature (104)..(104): Xaa can be any naturally occurring amino acid
  misc_feature (111)..(111): Xaa can be any naturally occurring amino acid
  misc_feature (114)..(115): Xaa can be any naturally occurring amino acid
  misc_feature (117)..(117): Xaa can be any naturally occurring amino acid
  misc_feature (120)..(120): Xaa can be any naturally occurring amino acid
  misc_feature (122)..(122): Xaa can be any naturally occurring amino acid
  misc_feature (124)..(124): Xaa can be any naturally occurring amino acid
  misc_feature (129)..(129): Xaa can be any naturally occurring amino acid
  misc_feature (134)..(134): Xaa can be any naturally occurring amino acid
  misc_feature (136)..(138): Xaa can be any naturally occurring amino acid
  misc_feature (206)..(206): Xaa can be any naturally occurring amino acid
  misc_feature (221)..(231): Xaa can be any naturally occurring amino acid
MASLVKKDMCXKMTMEGTVNGXHFKCXGEGXGXPFEGTQXXXXRXTEGXPLPFAXDILXPCCXYGSKTFIKHXSGIPDYFKXSFPEGFTWERTXIXEDGGXLTXHQDTSLXGNXXIXKVXVXGXNFPAXGPVMXKXXXGWEPCVEMLYPRDGVLCGQSLMALKCTDGNHLTSHLRTTYRSRKPSNAVNMPEFHFGDHRIEILKAEXGKFYEQYESAVARYXXXXXXXXXXX

SEQ ID NO: 550 - protein, 226 aa, Escherichia coli
  misc_feature (10)..(10): Xaa can be any naturally occurring amino acid
  misc_feature (13)..(13): Xaa can be any naturally occurring amino acid
  misc_feature (16)..(16): Xaa can be any naturally occurring amino acid
  misc_feature (26)..(26): Xaa can be any naturally occurring amino acid
  misc_feature (28)..(28): Xaa can be any naturally occurring amino acid
  misc_feature (30)..(30): Xaa can be any naturally occurring amino acid
  misc_feature (34)..(34): Xaa can be any naturally occurring amino acid
  misc_feature (38)..(38): Xaa can be any naturally occurring amino acid
  misc_feature (43)..(43): Xaa can be any naturally occurring amino acid
  misc_feature (63)..(64): Xaa can be any naturally occurring amino acid
  misc_feature (66)..(66): Xaa can be any naturally occurring amino acid
  misc_feature (74)..(74): Xaa can be any naturally occurring amino acid
  misc_feature (78)..(78): Xaa can be any naturally occurring amino acid
  misc_feature (91)..(91): Xaa can be any naturally occurring amino acid
  misc_feature (97)..(97): Xaa can be any naturally occurring amino acid
  misc_feature (99)..(99): Xaa can be any naturally occurring amino acid
  misc_feature (105)..(106): Xaa can be any naturally occurring amino acid
  misc_feature (112)..(112): Xaa can be any naturally occurring amino acid
  misc_feature (114)..(114): Xaa can be any naturally occurring amino acid
  misc_feature (116)..(116): Xaa can be any naturally occurring amino acid
  misc_feature (119)..(119): Xaa can be any naturally occurring amino acid
  misc_feature (121)..(121): Xaa can be any naturally occurring amino acid
  misc_feature (125)..(125): Xaa can be any naturally occurring amino acid
  misc_feature (152)..(153): Xaa can be any naturally occurring amino acid
  misc_feature (162)..(162): Xaa can be any naturally occurring amino acid
  misc_feature (166)..(166): Xaa can be any naturally occurring amino acid
  misc_feature (171)..(171): Xaa can be any naturally occurring amino acid
  misc_feature (184)..(184): Xaa can be any naturally occurring amino acid
  misc_feature (189)..(189): Xaa can be any naturally occurring amino acid
  misc_feature (192)..(192): Xaa can be any naturally occurring amino acid
  misc_feature (198)..(198): Xaa can be any naturally occurring amino acid
  misc_feature (201)..(201): Xaa can be any naturally occurring amino acid
  misc_feature (204)..(204): Xaa can be any naturally occurring amino acid
  misc_feature (207)..(208): Xaa can be any naturally occurring amino acid
  misc_feature (220)..(220): Xaa can be any naturally occurring amino acid
  misc_feature (222)..(226): Xaa can be any naturally occurring amino acid
MSLSKQVLPXDVXMRXHMDGCVNGHXFXIXGEGXGKPXEGKKXLKLRVTKGGPLPFAFDILSXXFXYGNRCFCXYPEXMPDYFKQSLPEGXSWERTXMXEDGGCXXASAHIXLXKXCFXHXSTFXGVNFPANGPVMQKKTLNWEPSSELITXXDGILKGDVXMFLXLEGGXRLKCQFTTSYKAXKAVKXPPXHIIEHXLVXKEXADXXQIQEHAVAKHFXVXXXXX

SEQ ID NO: 551 - protein, 236 aa, Escherichia coli; identical to SEQ ID NO: 11

SEQ ID NO: 552 - protein, 233 aa, Escherichia coli; identical to SEQ ID NO: 496

SEQ ID NO: 553 - protein, 232 aa, Escherichia coli; identical to SEQ ID NO: 2

SEQ ID NO: 554 - protein, 231 aa, Escherichia coli; identical to SEQ ID NO: 7

SEQ ID NO: 555 - protein, 237 aa, Escherichia coli
  misc_feature (41)..(42): Xaa can be any naturally occurring amino acid
  misc_feature (44)..(44): Xaa can be any naturally occurring amino acid
  misc_feature (46)..(46): Xaa can be any naturally occurring amino acid
  misc_feature (48)..(49): Xaa can be any naturally occurring amino acid
  misc_feature (78)..(82): Xaa can be any naturally occurring amino acid
  misc_feature (85)..(85): Xaa can be any naturally occurring amino acid
  misc_feature (152)..(152): Xaa can be any naturally occurring amino acid
  misc_feature (204)..(204): Xaa can be any naturally occurring amino acid
  misc_feature (206)..(211): Xaa can be any naturally occurring amino acid
MTALTEGAKLFEKEIPYITELEGDVEGMKFIIKGEGTGDAXXGXIXAXXICTTGDVPVPWSTLVTTLTYGAQCFAKYXXXXXDFXKSCMPEGYVQERTITFEGDGVFKTRAEVTFENGSVYNRVKLNGQGFKKDGHVLGKNLEFNFTPHCLXIWGDQANHGLKSAFKIMHEITGSKEDFIVADHTQMNTPIGGGPVHVPEYHHXTXXXXXXKDPDDDETDHLNIVEVIKAVDLETYR

SEQ ID NO: 556 - protein, 233 aa, Escherichia coli
  misc_feature (5)..(6): Xaa can be any naturally occurring amino acid
  misc_feature (9)..(11): Xaa can be any naturally occurring amino acid
  misc_feature (15)..(15): Xaa can be any naturally occurring amino acid
  misc_feature (38)..(39): Xaa can be any naturally occurring amino acid
  misc_feature (41)..(43): Xaa can be any naturally occurring amino acid
  misc_feature (45)..(46): Xaa can be any naturally occurring amino acid
  misc_feature (53)..(53): Xaa can be any naturally occurring amino acid
  misc_feature (75)..(78): Xaa can be any naturally occurring amino acid
  misc_feature (82)..(82): Xaa can be any naturally occurring amino acid
  misc_feature (85)..(85): Xaa can be any naturally occurring amino acid
  misc_feature (122)..(122): Xaa can be any naturally occurring amino acid
  misc_feature (124)..(124): Xaa can be any naturally occurring amino acid
  misc_feature (126)..(127): Xaa can be any naturally occurring amino acid
  misc_feature (146)..(148): Xaa can be any naturally occurring amino acid
MSSGXXLFXXXIPYXTELEGDVNGMKFTIHGKGTGDAXXGXXXAXXICTTGDXPVPWATLVSTLSYGVQCFAKYXXXXKDFXKSXMPEGYVQERTITFEGDGVFKTRAEVTFENGSVYNRVXLXGXXFKKDGHILRKNVAFQCPPXXXYILPDTVNNGIRVEFNQAYDIEGVTEKLVTKCSQMNRPLAGSAAVHIPRYHHLSKHTKLSKDRDERRDHMCLVEVVKAVDLDTYQ

What is claimed is:

1. A nucleic acid encoding a non-natural chromo- or fluorescent protein, wherein the chromo- or fluorescent protein has a sequence identity of at least 95% with SEQ ID NO: 57.

2. The nucleic acid according to claim 1, wherein the chromo- or fluorescent protein has a sequence comprising SEQ ID NO: 57.

3. The nucleic acid according to claim 1, wherein the protein has a sequence identity of at least 98% with SEQ ID NO: 57.

4. An expression cassette comprising a transcriptional initiation region and a non-natural chromo- or fluorescent protein according to any one of claims 1, 2, or 3.

5. An isolated host cell comprising an expression cassette according to claim 4.

6. An expression vector comprising (a) a transcriptional initiation sequence; (b) a first nucleic acid sequence encoding a non-natural chromo- or fluorescent protein according to any one of claims 1, 2 and 3; and (c) a second nucleic acid sequence.

7. The expression vector of claim 6, further comprising a linker sequence interposed between the first and the second nucleic acid sequences.

8. The expression vector of claim 7, wherein the linker sequence comprises an internal ribosomal entry site (IRES).

9. The expression vector of claim 7, wherein the linker sequence comprises a sequence encoding a cis-acting hydrolase element (CHYSEL) or 2A peptide.

10. The expression vector of claim 8, wherein the linker sequence comprises SEQ ID NO: 459.

11. The expression vector of claim 9 wherein the linker sequence comprises SEQ ID NO: 511.

12. The expression vector of claim 6, further comprising a TTAA-target site specific insertion element.

13. The expression vector of claim 6, further comprising a nucleic acid encoding an integrase sequence.

14. The expression vector of claim 12, wherein the TTAA-target site specific insertion element is a piggyBac or a tag-along sequence.

15. The expression vector of claim 14, wherein the sequence of the expression vector comprises any of SEQ ID NOS: 460-462.

16. The expression vector of claim 6, further comprising a Lentiviral LTR insertion element.

17. The expression vector of claim 16, wherein the Lentiviral LTR sequence is any of SEQ ID NOS: 463-465.

18. The method of quantitatively assessing the level of transcriptional initiation by a promoter using a nucleic acid encoding a non-natural chromo- or fluorescent protein according to any of claims 1, 2 or 3.

19. The method of quantitatively assessing the level of an extrachromosomal genetic construct using a nucleic acid encoding a non-natural chromo- or fluorescent protein according to any of claims 1, 2 or 3.

20. The method of quantitatively assessing the level of expression of the second nucleic acid according to claim 6 in an extrachromosomal genetic construct using a nucleic acid according to any of claims 1, 2 or 3.

21. A method of quantitatively assessing the expression of the second nucleic acid in an expression vector of claim 7 comprising
    (a) introducing the expression vector of claim 8 into a host cell; and
    (b) measuring the expression of the first nucleic acid of claim 8;
    wherein the expression of the first nucleic acid is a monotonic function of the level of expression of the second nucleic acid.

22. The method of claim 21 wherein the expression of the first nucleic acid is proportional to the level of expression of the second nucleic acid.

23. A method of quantitatively assessing the expression of the second nucleic acid in an expression vector of claim 7 comprising
    (a) introducing the expression vector of claim 7 into a host cell; and
    (b) measuring the expression of the first nucleic acid of claim 7;
    wherein the expression of the first nucleic acid over a predetermined time period is a monotonic function of the level of expression of the second nucleic acid over the predetermined time period.

24. A multicistronic vector comprising a nucleic acid of any one of claims 1, 2 or 3.

* * * * *